US009777288B2

(12) United States Patent
Beattie et al.

(10) Patent No.: US 9,777,288 B2
(45) Date of Patent: Oct. 3, 2017

(54) COMPOSITIONS AND METHODS FOR CONTROLLING LEPTINOTARSA

(71) Applicant: Monsanto Technology LLC, St. Louis, MO (US)

(72) Inventors: Jodi Lynn Beattie, Wentzville, MO (US); Michael John Crawford, Chesterfield, MO (US); Brian Donovan Eads, Ballwin, MO (US); Lex Evan Flagel, St. Louis, MO (US); Mahak Kapoor, Chesterfield, MO (US); Christina Marie Taylor, Chesterfield, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 36 days.

(21) Appl. No.: 14/335,135

(22) Filed: Jul. 18, 2014

(65) Prior Publication Data

US 2015/0143580 A1    May 21, 2015

Related U.S. Application Data

(60) Provisional application No. 61/980,800, filed on Apr. 17, 2014, provisional application No. 61/899,000, filed on Nov. 1, 2013, provisional application No. 61/856,137, filed on Jul. 19, 2013.

(51) Int. Cl.
| | |
|---|---|
| *A01N 57/16* | (2006.01) |
| *C12N 15/11* | (2006.01) |
| *C12N 15/82* | (2006.01) |
| *C07K 14/435* | (2006.01) |
| *C12N 15/113* | (2010.01) |

(52) U.S. Cl.
CPC ......... *C12N 15/8286* (2013.01); *A01N 57/16* (2013.01); *C07K 14/43563* (2013.01); *C12N 15/113* (2013.01); *C12N 15/8218* (2013.01); *C12N 2310/14* (2013.01)

(58) Field of Classification Search
None
See application file for complete search history.

(56) References Cited

U.S. PATENT DOCUMENTS

| | | | |
|---|---|---|---|
| 3,687,808 A | 8/1972 | Merigan et al. | |
| 3,791,932 A | 2/1974 | Schuurs et al. | |
| 3,839,153 A | 10/1974 | Schuurs et al. | |
| 3,850,578 A | 11/1974 | McConnell | |
| 3,850,752 A | 11/1974 | Schuurs et al. | |
| 3,853,987 A | 12/1974 | Dreyer | |
| 3,867,517 A | 2/1975 | Ling | |
| 3,879,262 A | 4/1975 | Schuurs et al. | |
| 3,901,654 A | 8/1975 | Gross | |
| 3,935,074 A | 1/1976 | Rubenstein et al. | |
| 3,984,533 A | 10/1976 | Uzgiris | |
| 3,996,345 A | 12/1976 | Ullman et al. | |
| 4,034,074 A | 7/1977 | Miles | |
| 4,098,876 A | 7/1978 | Piasio et al. | |
| 4,469,863 A | 9/1984 | Ts'o et al. | |
| 4,476,301 A | 10/1984 | Imbach et al. | |
| 4,535,060 A | 8/1985 | Comai | |
| 4,581,847 A | 4/1986 | Hibberd et al. | |
| 4,666,828 A | 5/1987 | Gusella | |
| 4,683,202 A | 7/1987 | Mullis | |
| 4,761,373 A | 8/1988 | Anderson et al. | |
| 4,769,061 A | 9/1988 | Comai | |
| 4,801,531 A | 1/1989 | Frossard | |
| 4,810,648 A | 3/1989 | Stalker | |
| 4,879,219 A | 11/1989 | Wands et al. | |
| 4,940,835 A | 7/1990 | Shah et al. | |
| 4,971,908 A | 11/1990 | Kishore et al. | |
| 5,004,863 A | 4/1991 | Umbeck | |
| 5,011,771 A | 4/1991 | Bellet et al. | |
| 5,013,659 A | 5/1991 | Bedbrook et al. | |
| 5,015,580 A | 5/1991 | Christou et al. | |
| 5,023,243 A | 6/1991 | Tullis | |
| 5,034,506 A | 7/1991 | Summerton et al. | |
| 5,094,945 A | 3/1992 | Comai | |
| 5,141,870 A | 8/1992 | Bedbrook et al. | |
| 5,145,783 A | 9/1992 | Kishore et al. | |

(Continued)

FOREIGN PATENT DOCUMENTS

| | | |
|---|---|---|
| CN | 101279950 A | 10/2008 |
| CN | 101279951 A | 10/2008 |

(Continued)

OTHER PUBLICATIONS

Emery et al, Current Biology 13:1768-1774, 2003.*
XM_014456745 sequence.*
Alarcón-Reverte et al., "Resistance to ACCase-inhibiting herbicides in the weed *Lolium multiflorum*," *Comm. Appl. Biol. Sci.*, 73(4):899-902 (2008).
Amarzguioui et al., "An algorithm for selection of functional siRNA sequences," *Biochemical and Biophysical Research Communications*, 316:1050-1058 (2004).
Ambrus et al., "The Diverse Roles of RNA Helicases in RNAi," *Cell Cycle*, 8(21):3500-3505 (2009).
An et al., "Transient RNAi Induction against Endogenous Genes in Arabidopsis Protoplasts Using in Vitro-Prepared Double-Stranded RNA," *Biosci Biotechnol Biochem*, 69(2):415-418 (2005).
Anonymous, "A handbook for high-level expression and purification of 6xHis-tagged proteins," *The QIAexpressionist*, (2003).
Anonymous, "Devgen, The mini-Monsanto," KBC Securities (2006).

(Continued)

*Primary Examiner* — Medina A Ibrahim
*Assistant Examiner* — Wayne Zhong
(74) *Attorney, Agent, or Firm* — Amanda Carmany-Rampey; David Marsh; Arnold & Porter Kaye Scholer LLP

(57) ABSTRACT

Disclosed herein are methods of controlling insect pests, in particular *Leptinotarsa* spp. which infest crop plants, and methods of providing plants resistant to such pests. Also disclosed are polynucleotides and recombinant DNA molecules and constructs useful in such methods, insecticidal compositions such as topical sprays containing insecticidal double-stranded RNAs, and solanaceous plants with improved resistance to infestation by *Leptinotarsa* spp. Further disclosed are methods of selecting target genes for RNAi-mediated silencing and control of *Leptinotarsa* spp.

18 Claims, No Drawings

(56) References Cited

U.S. PATENT DOCUMENTS

| | | |
|---|---|---|
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A | 11/1999 | Sandbrink et al. |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 | 11/2002 | Kumagai et al. |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,992,237 B1 | 1/2006 | Habben et al. |

(56) References Cited

U.S. PATENT DOCUMENTS

| | | |
|---|---|---|
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 * | 5/2011 | Baum et al. .................. 800/285 |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,548,778 B1 | 10/2013 | Hart et al. |
| 8,554,490 B2 | 10/2013 | Tang et al. |
| 9,121,022 B2 | 9/2015 | Sammons et al. |
| 9,445,603 B2 | 9/2016 | Baum et al. |
| 2001/0006797 A1 | 7/2001 | Kumagai et al. |
| 2001/0042257 A1 | 11/2001 | Connor-Ward et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2004/0029275 A1 | 2/2004 | Brown et al. |
| 2004/0053289 A1 | 3/2004 | Christian et al. |
| 2004/0055041 A1 | 3/2004 | Labate et al. |
| 2004/0072692 A1 | 4/2004 | Hoffmann et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cai et al. |
| 2005/0005319 A1 | 1/2005 | della-Cioppa et al. |
| 2005/0215435 A1 | 9/2005 | Menges et al. |
| 2005/0250647 A1 | 11/2005 | Hills et al. |
| 2006/0009358 A1 | 1/2006 | Kibler et al. |
| 2006/0021087 A1 | 1/2006 | Baum et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffmann et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0021360 A1 | 1/2007 | Nyce et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0165153 A1 | 6/2009 | Wang et al. |
| 2009/0165166 A1 | 6/2009 | Feng et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |
| 2011/0152353 A1 | 6/2011 | Koizumi |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0164205 A1 * | 6/2012 | Baum .................. A01N 63/02 424/409 |
| 2012/0185967 A1 | 7/2012 | Sela et al. |
| 2012/0230565 A1 | 9/2012 | Steinberg et al. |
| 2012/0258646 A1 | 10/2012 | Sela et al. |
| 2013/0041004 A1 | 2/2013 | Drager et al. |
| 2013/0047297 A1 | 2/2013 | Sammons et al. |
| 2013/0047298 A1 | 2/2013 | Tang |
| 2013/0060133 A1 | 3/2013 | Kassab et al. |
| 2013/0067618 A1 | 3/2013 | Ader et al. |
| 2013/0084243 A1 | 4/2013 | Goetsch et al. |

(56) References Cited

U.S. PATENT DOCUMENTS

| | | | |
|---|---|---|---|
| 2013/0096073 A1 | 4/2013 | Sidelman | |
| 2013/0097726 A1 | 4/2013 | Ader et al. | |
| 2013/0212739 A1 | 8/2013 | Giritch et al. | |
| 2013/0226003 A1 | 8/2013 | Edic et al. | |
| 2013/0247247 A1 | 9/2013 | Ader et al. | |
| 2013/0254940 A1 | 9/2013 | Ader et al. | |
| 2013/0254941 A1 | 9/2013 | Ader et al. | |
| 2013/0288895 A1 | 10/2013 | Ader et al. | |
| 2013/0318657 A1* | 11/2013 | Avniel | C12N 15/113 800/285 |
| 2013/0318658 A1 | 11/2013 | Ader et al. | |
| 2013/0324842 A1 | 12/2013 | Mittal et al. | |
| 2013/0326731 A1 | 12/2013 | Ader et al. | |
| 2014/0018241 A1 | 1/2014 | Sammons et al. | |
| 2014/0057789 A1 | 2/2014 | Sammons et al. | |
| 2014/0109258 A1 | 4/2014 | Van De Craen et al. | |
| 2014/0230090 A1 | 8/2014 | Avniel et al. | |
| 2014/0274712 A1 | 9/2014 | Finnessy et al. | |
| 2014/0275208 A1 | 9/2014 | Hu et al. | |
| 2014/0296503 A1 | 10/2014 | Avniel et al. | |
| 2015/0096079 A1 | 4/2015 | Avniel et al. | |
| 2015/0143580 A1 | 5/2015 | Beattie et al. | |
| 2015/0159156 A1 | 6/2015 | Inberg et al. | |
| 2015/0203867 A1 | 7/2015 | Beattie et al. | |
| 2015/0240258 A1 | 8/2015 | Beattie et al. | |
| 2016/0015035 A1 | 1/2016 | Tao | |
| 2016/0029644 A1 | 2/2016 | Tao | |

FOREIGN PATENT DOCUMENTS

| | | |
|---|---|---|
| CN | 101914540 A | 12/2010 |
| DE | 288618 A5 | 4/1991 |
| DE | 10000600 A1 | 7/2001 |
| DE | 10116399 A1 | 10/2002 |
| DE | 10256353 A1 | 6/2003 |
| DE | 10256354 A1 | 6/2003 |
| DE | 10256367 A1 | 6/2003 |
| DE | 10204951 A1 | 8/2003 |
| DE | 10234875 A1 | 2/2004 |
| DE | 10234876 A1 | 2/2004 |
| DE | 102004054666 A1 | 5/2006 |
| DE | 102005014638 A1 | 10/2006 |
| DE | 102005014906 A1 | 10/2006 |
| DE | 102007012168 A1 | 9/2008 |
| DE | 102010042866 A1 | 5/2011 |
| EP | 0 804 600 A1 | 11/1997 |
| EP | 1 157 991 A2 | 11/2001 |
| EP | 1 238 586 A1 | 9/2002 |
| EP | 1 416 049 A1 | 5/2004 |
| EP | 2 147 919 A1 | 1/2010 |
| EP | 2 160 098 B1 | 11/2010 |
| EP | 2 530 159 A1 | 3/2011 |
| EP | 2 305 813 A2 | 4/2011 |
| EP | 2 545 182 A1 | 1/2013 |
| JP | 2001253874 A | 9/2001 |
| JP | 2002080454 A | 3/2002 |
| JP | 2002138075 A | 5/2002 |
| JP | 2002145707 A | 5/2002 |
| JP | 2002220389 A | 8/2002 |
| JP | 2003064059 A | 3/2003 |
| JP | 2003096059 A | 4/2003 |
| JP | 2004051628 A | 2/2004 |
| JP | 2004107228 A | 4/2004 |
| JP | 2005008583 A | 1/2005 |
| JP | 2005239675 A | 9/2005 |
| JP | 2005314407 A | 11/2005 |
| JP | 2006232824 A | 9/2006 |
| JP | 2006282552 A | 10/2006 |
| JP | 2007153847 A | 6/2007 |
| JP | 2007161701 A | 6/2007 |
| JP | 2007182404 A | 7/2007 |
| JP | 2008074840 A | 4/2008 |
| JP | 2008074841 A | 4/2008 |
| JP | 2008133207 A | 6/2008 |
| JP | 2008133218 A | 6/2008 |
| JP | 2008169121 A | 7/2008 |
| JP | 2009067739 A | 4/2009 |
| JP | 2009114128 A | 5/2009 |
| JP | 2009126792 A | 6/2009 |
| JP | 2009137851 A | 6/2009 |
| WO | WO 89/11789 A1 | 12/1989 |
| WO | WO 95/34659 A1 | 12/1995 |
| WO | WO 95/34668 A2 | 12/1995 |
| WO | WO 96/05721 A1 | 2/1996 |
| WO | WO 96/33270 A1 | 10/1996 |
| WO | WO 96/38567 A2 | 12/1996 |
| WO | WO 96/40964 A2 | 12/1996 |
| WO | WO 97/49816 A1 | 12/1997 |
| WO | WO 99/24585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/32757 A2 | 6/2000 |
| WO | WO 00/44914 A1 | 8/2000 |
| WO | WO 02/14472 A2 | 2/2002 |
| WO | WO 02/066660 A2 | 8/2002 |
| WO | WO 03/000679 A2 | 1/2003 |
| WO | WO 03/006422 A1 | 1/2003 |
| WO | WO 03/012052 A2 | 2/2003 |
| WO | WO 03/013247 A1 | 2/2003 |
| WO | WO 03/016308 A1 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A1 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A2 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |

(56) References Cited

FOREIGN PATENT DOCUMENTS

| WO | WO 2005/107437 A2 | 11/2005 |
| --- | --- | --- |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/039454 A1 | 4/2007 |
| WO | WO 2007/050715 A2 | 5/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/096576 A1 | 8/2007 |
| WO | WO 2007/051462 A2 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/035150 A2 | 3/2009 |
| WO | WO 2009/046384 A1 | 4/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/152995 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A1 | 10/2014 |
| WO | WO 2015/010026 A2 | 1/2015 |

OTHER PUBLICATIONS

Anonymous, "Do Monsanto have the next big thing?,"*Austalian Herbicide Resistance Initiative (AHRI)*, (Apr. 23, 2013) *Web*. (Jan. 19, 2015).

Aoki et al., "In Vivo Transfer Efficiency of Antisense Oligonucleotides into the Myocardium Using HVJ—Liposome Method," *Biochem Biophys Res Commun*, 231:540-545 (1997).

Arpaia et al., "Production of transgenic eggplant (*Solanum melongena* L.) resistant to Colorado Potato Beetle (*Leptinotarsa decemlineata* Say)," (1997) *Theor. Appl. Genet.*, 95:329-334 (1997).

Artmymovich, "Using RNA interference to increase crop yield and decrease pest damage," *MMG 445 Basic Biotech.*, 5(1):7-12 (2009).

Australian Patent Examination report No. 1 issued Nov. 11, 2013, in Australian Application No. 2011224570.

Axtell el al., "A Two-Hit Trigger for siRNA Biogenesis in Plants," *Cell*, 127:565-577 (2006).

Baerson et al., "Glyphosate-Resistant Goosegrass. Identification of a Mutation in the Target Enzyme 5-Enolpyruvylshikimate-3-Phosphate Synthase," *Plant Physiol.*, 129(3):1265-1275 (2002).

Bannerjee et al., "Efficient production of transgenic potato (S. *tuberosum* L. ssp. *andigena*) plants via *Agrobacterium tumefaciens*-mediated transformation," *Plant Sci.*, 170:732 738 (2006).

Baulcombe, "RNA silencing and heritable epigenetic effects in tomato and Arabidopsis," Abstract 13th Annual Fall Symposium, Plant Genomes to Phenomes, Donald Danforth Plant Science Center, 28-30 (2011).

Bayer et al., "Programmable ligand-controlled riboregulators of eukaryotic gene expression," *Nature Biotechnol.*, 23(3):337-343 (2005).

Beal, et al., "Second Structural Motif for Recognition of DNA by Oligonucleotide-Directed Triple-Helix Formation," *Science*, 251:1360-1363 (1992).

Becker et al., "Fertile transgenic wheat from microprojectile bombardment of scutellar tissue," *The Plant Journal*, 5(2):299-307 (1994).

Bhargava et al., "Long double-stranded RNA-mediated RNA interference as a tool to achieve site-specific silencing of hypothalamic neuropeptides," *Brain Research Protocols*, 13:115-125 (2004).

(56) References Cited

OTHER PUBLICATIONS

Boletta et al., "High Efficient Non-Viral Gene Delivery to the Rat Kidney by Novel Polycationic Vectors," *J. Am Soc. Nephrol.*, 7:1728 (1996).
Bolognesi et al., "Characterizing the Mechanism of Action of Double-Stranded RNA Activity against Western Corn Rootworm(*Diahrotica virgifera virgifera* LeConte)," PLoS One 7(10):e47534 (2012).
Bolter el al., "A chloroplastic inner envelope membrane protease is essential for plant development," *FEBS Letters*, 580:789-794 (2006).
Breaker et al., "A DNA enzyme with $Mg2^+$-dependent RNA phosphoesterase activity," *Chemistry and Biology*, 2:655-660 (1995).
Brodersen et al., "The diversity of RNA silencing pathways in plants," *Trends in Genetics*, 22(5):268-280 (2006).
Butler et al., "Priming and re-drying improve the survival of mature seeds of *Digitalis purpurea* during storage," *Annals of Botany*, 103:1261-1270 (2009).
Bytebier et al., "T-DNA organization in tumor cultures and transgenic plants of the monocotyledon *Asparagus officinalis,*" *Proc. Natl. Acad. Sci. U.S.A.*, 84:5345-5349 (1987).
Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).
Chee et al., "Transformation of Soybean (*Glycine max*) by Infecting Germinating Seeds with *Agrobacterium tumefaciens,*" *Plant Physiol.*, 91:1212-1218 (1989).
Chen et al., "In Vivo Analysis of the Role of atTic20 in Protein Import into Chloroplasts," *The Plant Cell*, 14:641-654 (2002).
Cheng et al., "Production of fertile transgenic peanut (*Arachis hypogaea* L.) plants using *Agrobacterium tumefaciens,*" *Plant Cell Reports*, 15:653-657 (1996).
Chi et al., "The Function of RII22, a Dead RNA IIelicase, in the Biogenesis of the 50S Ribosomal Subunits of Arabidopsis Chloroplasts," *Plant Physiology*, 158:693-707 (2012).
Chinese Office Action issued Aug. 28, 2013 in Chinese Application No. 201180012795.2.
Clough et al., "Floral dip: a simplified method for Agrobacterium-mediated transformation of *Arabidopsis thaliana,*" *The Plant Journal*, 16(6):735-743 (1998).
CN101914540 Patent Diclosure, "Introduction of RNA into plant by interference," (2010).
Colbourne et al., "The Ecoresponsive Genome of Daphnia pulex," *Science*, 331(6017):555-561 (2011).
Colombian Office Action issued Aug. 2, 2013 in Application No. 12 152898.
Colombian Office Action issued Feb. 21, 2014 in Application No. 12 152898.
Cooney et al., "Site-Specific Oligonucleotide Binding Represses Transcription of the Human c-myc Gene in Vitro," *Science*,241:456-459 (1988).
COST Action FA0806 progress report "Plant virus control employing RNA-based vaccines: A novel non-transgenic strategy" (2010).
Coticchia el al., "Calmodulin modulates Akt activity in human breast cancer cell lines," *Breast Cancer Res. Treat*, 115:545-560 (2009).
Dalmay et al., "An RNA-Depenedent RNA Polymerase Gene in *Arabidopsis* Is Required for Posttranscriptional Gene Silencing Mediated by a Transgene but Not by a Virus," *Cell*, 101:543-553 (2000).
Database EMBL CBIB Daphnia—XP-002732239 (2011).
Davidson et al., "Engineering regulatory RNAs," *TRENDS in Biotechnology*, 23(3):109-112 (2005).
De Block, et al. "Engineering herbicide resistance in plants by expression of a detoxifying enzyme," *EMBO J.* 6(9):2513-2519 (1987).
De Framond, "Mini-Ti: A New Vector Strategy for Plant Genetic Engineering," *Nature Biotechnology*, 1:262-269 (1983).

della-Cioppa et al., "Import of a precursor protein into chloroplasts is inhibited by the herbicide glyphosate," *The EMBO Journal*, 7(5):1299-1305 (1988).
Diallo et al., "Long Endogenous dsRNAs Can Induce Complete Gene Silencing in Mammalian Cells and Primary Cultures," *Oligonucleotides*, 13:381-392 (2003).
Dietemann et al.,"Varroa destructor: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Eurasian Office Action issued Feb. 24, 2014, in Application No. 201201264.
European Cooperation in the field of Scientific and Technical Research—Memorandum of Understanding for COST Action FA0806 (2008).
European Supplemental Search Report issued Oct. 8, 2013 in Application No. 11753916.3.
Farooq et al., "Rice seed priming," *IPRN*, 30(2):45-48 (2005).
Fire et al., "Potent and specific genetic interference by double-stranded RNA in *Caenorhabditis elegans,*" *Nature*, 391:806-811 (1998).
First Examination Report issued on Apr. 23, 2013, in New Zealand Patent Application No. 601784.
First Examination Report issued on Jul. 28, 2014, in New Zealand Patent Application No. 627060.
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Further Examination Report issued in New Zealand Patent Application No. 601784 on May 16, 2014.
Gaines et al., "Gene amplification confers glyphosate resistance in *Amaranthus palmeri,*" *Proc. Natl. Acad. Sci. USA*, 107(3):1029-1034 (2010).
Gallie et al., "Identification of the motifs within the tobacco mosaic virus 5'-leader responsible for enhancing translation," *Nucleic Acids Res.*, 20(17):4631-4638 (1992).
Gan et al., "Bacterially expressed dsRNA protects maize against SCMV infection," *Plant Cell Rep*, 11:1261-1268 (2010).
Ge et al., "Rapid vacuolar sequestration: the horseweed glyphosate resistance mechanism," *Pest Management Sci.*, 66:345-348 (2010).
GenBank Accession No. DY640489, PU2_plate27_F03 PU2 Prunus persica cDNA similar to expressed mRNA inferred from Prunus persica hypothetical domain/motif containing IPR011005:Dihydropteroate synthase-like, MRNA sequence (2006) [Retrieved on Feb. 4, 2013]. Retrieved from the internet <URL: http://www.ncbi.nlm.nih.gov/nucest/DY640489>.
GenBank Accession No. EU24568—"Amaranthus hypochondriacus acetolactate synthase (ALS) gene," (2007).
GenBank Accession No. FJ972198, Solarium lycopersicum cultivar Ailsa Craig dihydropterin pyrophosphokinase-dihydropteroate synthase (IIPPK-DIIPS) gene, complete cds (2010) [Retrieved on Nov. 26, 2012]. Retrieved from the internet ,URL: http://www.ncbi.nlm.nih.gov/nuccore/FJ972198>.
GenBank accession No. AY545657.1, published 2004.
GenBank accession No. GI:186478573, published Jan. 22, 2014.
GenEmbl FJ861243, published Feb. 3, 2010.
Gong et al., "Silencing of Rieske iron—sulfur protein using chemically synthesised siRNA as a potential biopesticide against Plutella xylostella," *Pest Manag Sci*, 67:514-520 (2011).
Gutensohn et al., "Functional analysis of the two *Arabidopsis* homologues of Toc34, a component of the chloroplast protein import apparatus," *The Plant Journal*, 23(6):771-783 (2000).

(56) References Cited

OTHER PUBLICATIONS

Haigh, "The Priming of Seeds: Investigation into a method of priming large quantities of seeds using salt solutions," Thesis submitted to Macquarie University (1983).
Hamilton et al., "Guidelines for the Identification and Characterization of Plant Viruses," *J. gen. Virol.*, 54:223-241 (1981).
Hamilton et al., "Two classes of short interfering RNA in RNA silencing," *EMBO J*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Herman et al., "A three-component dicamba O-demethylase from *Pseudomonas maltophilia*, strain DI-6: gene isolation, characterization, and heterologous expression,"*J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus,*" *Science*, 222:1346-1349 (1983).
Hoekema et al., "A binary plant vector strategy based on separation of vir- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Hsieh et al., "A library of siRNA duplexes targeting the phosphoinositide 3-kinase pathway: determinants of gene silencing for use in cell-based screens," *Nucleic Acids Res.*, 32(3):893-901 (2004).
Huesken et al., "Design of a genome-wide siRNA library using an artificial neural network," *Nature Biotechnology*, 23(8): 995-1001 (2005).
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," *Nucleic Acids Res.*, 35(18):e123 (2007).
International Preliminary Report on Patentability issued on Sep. 11, 2014, in International Application No. PCT/IL13/50447.
International Search Report and the Written Opinion dated May 10, 2011, in International Application No. PCT/US 11/27528.
International Search Report and the Written Opinion dated Feb. 25, 2013, in International Application No. PCT/US 12/54883.
International Search Report and the Written Opinion dated Feb. 27, 2013, in International Application No. PCT/US 12/54814.
International Search Report and the Written Opinion dated Feb. 27, 2013, in International Application No. PCT/US 12/54842.
International Search Report and the Written Opinion dated Feb. 27, 2013, in International Application No. PCT/US 12/54862.
International Search Report and the Written Opinion dated Feb. 27, 2013, in International Application No. PCT/US 12/54894.
International Search Report and the Written Opinion dated Feb. 27, 2013, in International Application No. PCT/US 12/54974.
International Search Report and the Written Opinion dated Feb. 27, 2013, in International Application No. PCT/US 12/54980.

International Search Report and the Written Opinion dated Oct. 1 2013, in International Application No. PCT/IL2013/050447.
International Search Report and the Written Opinion dated Jul. 15 2014, in International Application No. PCT/US2014/025305.
International Search Report and the Written Opinion dated Jul. 22 2014, in International Application No. PCT/IL2013/051083.
International Search Report and the Written Opinion dated Jul. 22 2014, in International Application No. PCT/IL2013/051085.
International Search Report and the Written Opinion dated Jul. 24 2014, in International Application No. PCT/US2014/026036.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report dated Mar. 12, 2013, in International Application No. PCT/US 12/54789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," *Nature Biotechnology*, 22(7):841-847 (2004).
Ji et al., "Regulation of small RNA stability: methylation and beyond," *Cell Research*, 22:624-636 (2012).
Jones-Rhoades et al., "MicroRNAs and Their Regulatory Roles in Plants," *Annu. Rev. Plant Biol.*, 57:19-53 (2006).
Josse et al., "A Della in Disguise: Spatula Restrains the Growth of the Developing *Arabidopsis* Seedling," *Plant Cell*, 23:1337-1351 (2011).
Kam et al., "Nanotube Molecular Transporters: Internalization of Carbon Nanotube—Protein Conjugates into Mammalian Cells," *J. Am. Chem. Soc.*, 126(22):6850-6851 (2004).
Katoh et al., "Specific residues at every third position of siRNA shape its efficient RNAi activity," *Nucleic Acids Res.*, 35(4): e27 (2007).
Kertbundit et al., "In vivo random β-glucuronidase gene fusions in *Arabidopsis thaliana,*" *Proc. Natl. Acad. Sci. U S A.*, 88:5212-5216 (1991).
Khachigian, "DNAzymes: Cutting a path to a new class of therapeutics," *Curr Opin Mol Ther* 4(2):119-121 (2002).
Khodakovskaya et al., "Carbon Nanotubes Are Able to Penetrate Plant Seed Coat and Dramatically Affect Seed Germination and Plant Growth," *ACS Nano*, 3(10):3221-3227 (2009).
Kirkwood, "Use and Mode of Action of Adjuvants for Herbicides: A Review of some Current Work," *Pestic Sci.*, 38:93-102 (1993).
Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Kronenwett et al., "Oligodeoxyribonucleotide Uptake in Primary Human Hematopoietic Cells Is Enhanced by Cationic Lipids and Depends on the Hematopoietic Cell Subset," *Blood*, 91(3):852-862 (1998).
Kumar et al., "Sequencing, De Novo Assembly and Annotation of the Colorado Potato Beetle, *Leptinotarsa decemlineata*,Transcriptome," *PLoS One*, 9(1):e86012 (2014).
Kusaba et al., "*Low glutelin content1*: A Dominant Mutation That Suppresses the *Glutelin* Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lesnik et al., "Prediction of rho-independent transcriptional terminators in *Escherichia coli,*" *Nucleic Acids Research*, 29(17):3583-3594 (2001).

(56) References Cited

OTHER PUBLICATIONS

Li et al.,"Establishment of a highly efficient transformation system for pepper (*Capsicum annuum*L.)," *Plant Cell Reports*, 21: 785-788 (2003).
Li et al., "The FAST technique: a simplified Agrobacterium-based transformation method for transient gene expression analysis in seedlings of Arabidopsis and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli*," *BMC Biotechnology*, 10:85 (2010).
Llave et al., "Endogenous and Silencing-Associated Small RNAs in Plants," *The Plant Cell*, 14:1605-1619 (2002).
Lu et al., "RNA silencing in plants by the expression of siRNA duplexes," *Nucleic Acids Res.*, 32(21):e171 (2004).
Lu et al., "OligoWalk: an online siRNA design tool utilizing hybridization thermodynamics," *Nucleic Acids Research*, 36:W104-W108 (2008).
' Luft "Making sense out of antisense oligodeoxynucleotide delivery: getting there is half the fun," *J Mol Med*, 76:75-76 (1998).
Maas et al., "Mechanism and optimized conditions for PEG mediated DNA transfection into plant protoplasts," *Plant Cell Reports*, 8:148-149 (1989).
Maher III et al., "Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitches and gene activation by disruption of a transcription terminator," *Nature Struct. Mol. Biol.*, 11(1):29-35 (2004).
Mandal et al., "Gene Regulation by Riboswitches," *Nature Reviews | Molecular Cell Biology*, 5:451-463 (2004).
Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva el al., "Prediction of antisense oligonucleotide efficacy by in vitro methods," *Nature Biotechnology*, 16:1374-1375 (1998).
Meinke, et al., "Identifying essential genes in *Arabidopsis thaliana*," *Trends Plant Sci.*, 13(9):483-491 (2008).
Meins et al., "RNA Silencing Systems and Their Relevance to Plant Development," *Annu. Rev. Cell Dev. Biol.*, 21:297-318 (2005).
Melnyk et al., "Intercellular and systemic movement of RNA silencing signals," *The EMBO Journal*, 30:3553-3563 (2011).
Misawa et al., "Functional expression of the *Erwinia uredovora* carotenoid biosynthesis gene crtl in transgenic plants showing an increase of β-carotene biosynthesis activity and resistance to the bleaching herbicide norflurazon," *The Plant Journal*, 4(5):833-840 (1993).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Miura et al., "The Balance between Protein Synthesis and Degradation in Chloroplasts Determines Leaf Variegation in *Arabidopsis yellow variegated* Mutants," *The Plant Cell*, 19:1313-1328 (2007).
Molnar et al., "Plant Virus-Derived Small Interfering RNAs Originate redominantly from Highly Structured Single-Stranded Viral RNAs," *Journal of Virology*, 79(12):7812-7818 (2005).

Molnar et al., "Small Silencing RNAs in Plants Are Mobile and Direct Epigenetic Modification in Recipient Cells," *Science*, 328:872-875 (2010).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).
Morrissey et al., "Potent and persistent in vivo anti-HBV activity of chemically modified siRNAs," *Nat Biotechnol*. 23(8):1002-1007 (2005).
Moser et al., "Sequence-Specific Cleavage of Double Helical DNA by Triple Helix Formation," *Science*, 238:645-646 (1987).
Nowak et al., "A new and efficient method for inhibition of RNA viruses by DNA interference," *The FEBS Journal*, 276:4372-4380 (2009)
Office Action dated Feb. 17, 2014, in Mexican Patent Application No. MX/a/2012/010479.
Office Action issued on Jan. 6, 2015, in Japanese Patent Application No. 2012-557165.
Office Action issued on Nov. 19, 2014, in Eurasian Patent Application No. 201201264/28.
Office Action issued on Nov. 3, 2014, in Chinese Patent Application No. 201180012795.2.
Ongvarrasopone et al., "A Simple and Cost Effective Method to Generate dsRNA for RNAi Studies in Invertebrates," *Science Asia*, 33:35-39 (2007).
Paddison el al., "Stable suppression of gene expression by RNAi in mammalian cells," *Proc. Natl Acad. Sci. USA*, 99(3):1443-1448 (2002).
Palauqui et al., "Activation of systemic acquired silencing by localised introduction of DNA," *Current Biology*, 9:59-66 (1999).
Parera et al., "Dehydration Rate after Solid Matrix Priming Alters Seed Performance of Shrunken-2 Corn," *J. Amer. Soc. Hort. Sci.*, 119(3):629-635 (1994).
Paungfoo-Lonhienne et al., "DNA is Taken up by Root Hairs and Pollen, and Stimulates Root and Pollen Tube Growth," *Plant Physiology*, 153:799-805 (2010).
Paungfoo-Lonhienne et al., "DNA uptake by Arabidopsis induces changes in the expression of CLE peptides which control root morphology," *Plant Signaling & Behavior*, 5(9):1112-1114 (2010).
Pei et al., "On the art of identifying effective and specific siRNAs," *Nature Methods*, 3(9):670-676 (2006).
Peretz et al., "A Universal Expression/Silencing Vector in Plants," *Plant Physiology*, 145:1251-1263 (2007).
Pornprom et al., "Glutamine synthetase mutation conferring target-site-based resistance to glufosinate in soybean cell selections," *Pest Manag Sci*, 2009; 65(2):216-222 (2009).
Preston et al., "Multiple effects of a naturally occurring proline to threonine substitution within acetolactate synthase in two herbicide-resistant populations of *Lactuca serriola*," *Pesticide Biochem. Physiol.*, 84(3):227-235 (2006).
Qiwei," Advance in DNA interference," *Progress in Veterinary Medicine*, 30(1):71-75 (2009).
Rajur el al., "Covalent Protein—Oligonucleotide Conjugates for Efficient Delivery of Antisense Molecules," *Bioconjug Chem.*, 8:935-940 (1997).
Reddy et al "Organosilicone Adjuvants Increased the Efficacy of Glyphosate for Control of Weeds in Citrus (*Citrus* spp.)" *HortScience* 27(9):1003-1005 (1992).
Reddy et al., "Aminomethylphosphonic Acid Accumulation in Plant Species Treated with Glyphosate," *J Agric. Food Chem.*, 56(6):2125-2130 (2008).
Reither et al., "Specificity of DNA triple helix formation analyzed by a FRET assay," *BMC Biochemistry*, 3:27 (2002).
Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).
Reynolds et al., "Rational siRNA design for RNA interference," *Nature Biotechnology*, 22:326-330 (2004).

(56) References Cited

OTHER PUBLICATIONS

Ryabov et al., "Cell-to-Cell, but Not Long-Distance, Spread of RNA Silencing That Is Induced in Individual Epidermal Cells," *Journal of Virology*, 78(6):3149-3154 (2004).
Ryan, "Human endogenous retroviruses in health and disease: a symbiotic perspective," *Journal of the Royal Society of Medicine*, 97:560-565 (2004).
Santoro et al., "A general purpose RNA-cleaving DNA enzyme," *Proc. Natl. Acad. Sci. USA*, 94:4262-4266 (1997).
Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).
Schwab et al., "RNA silencing amplification in plants: Size matters," *PNAS*, 107(34):14945-14946 (2010).
Schwember et al., "Drying Rates following Priming Affect Temperature Sensitivity of Germination and Longevity of Lettuce Seeds," *HortScience*, 40(3):778-781 (2005).
Second Chinese Office Action issued in Chinese Patent Application No. 201180012795.2, dated Jun. 10, 2014.
Seidman et al., "The potential for gene repair via triple helix formation," *J Clin Invest*., 112(4):487-494 (2003).
Selvarani et al., "Evaluation of seed priming methods to improve seed vigour of onion (*Allium cepa* cv. *Aggregatum*) and carrot (*Daucus carota*)," *Journal of Agricultural Technology*, 7(3):857-867 (2011).
Sharma et al., "A simple and efficient *Agrobacterium*-mediated procedure for transtformation of tomato," *J. Biosci.*, 34(3):423 433 (2009).
Sijen et al. "On the Role of RNA Amplification in dsRNA-Triggered Gene Silencing," *Cell*, 107:465-476 (2001).
Silwet L-77 Spray Adjuvant for agricultural applications, product description from Momentive Performance Materials, Inc. (2003).
Singh et al., "Absorption and translocation of glyphosate with conventional and organosilicone adjuvants," *Weed Biology and Management*, 8:104-111 (2008).
Steeves et al., "Transgenic soybeans expressing siRNAs specific to a major sperm protein gene suppress *Heterodera glycines* reproduction," *Funct. Plant Biol.*, 33:991-999 (2006).
Stock et al., "Possible Mechanisms for Surfactant-Induced Foliar Uptake of Agrochemicals," *Pestic. Sci.*, 38:165-177 (1993).
Strat et al., "Specific and nontoxic silencing in mammalian cells with expressed long dsRNAs," *Nucleic Acids Research*, 34(13):3803-3810 (2006).
Sudars an et al., "Metabolite-binding RNA domains are present in the genes of eukaryotes," *RNA*, 9:644-647 (2003).
Sun et al., "Antisense oligodeoxynucleotide inhibition as a potent strategy in plant biology: identification of SUSIBA2 as a transcriptional activator in plant sugar signalling," *The Plant Journal*, 44:128-138 (2005).
Sun et al., "A Highly efficient Transformation Protocol for Micro-Tom, a Model Cultivar for Tomato Functional Genomics," *Plant Cell Physiol.*, 47(3):426-431 (2006).
Sun et al., "Sweet delivery—sugar translocators as ports of entry for antisense oligodeoxynucleotides in plant cells," *The Plant Journal*, 52:1192-1198 (2007).
Takasaki et al., "An Effective Method for Selecting siRNA Target Sequences in Mammalian Cells," *Cell Cycle*, 3:790-795 (2004).
Temple et al., "Can glutamine synthetase activity levels be modulated in transgenic plants by the use of recombinant DNA technology?" *Transgenic Plants and Plant Biochemistry*, 22:915-920 (1994).
Templeton et al., "Improved DNA: liposome complexes for increased systemic delivery and gene expression," *Nature Biotechnology*, 15:647-652 (1997).
Tenllado et al., "Crude extracts of bacterially expressed dsRNA can be used to protect plants against virus infection," *BMC Biotechnology*, 3(3):1-11 (2003).
Tenllado et al., "RNA interference as a new biotechnological tool for the control of virus diseases in plants," *Virus Research*, 102:85-96 (2004).
Tepfer, "Risk assessment of virus resistant transgenic plants," *Annual Review of Phytopathology*, 40:467-491 (2002).
The Seed Biology Place, Website Gerhard Leubner Lab Royal Holloway, University of London, <http://www.seedbiology.de/seedtechnology.asp.
Third Party Submissionin U.S. Appl. No. 13/042,856, filed Nov. 29, 2012.
Thompson, et al., "Clustal W: improving the sensitivity of progressive multiple sequence alignment through sequence weighting, position-specific gap penalties and weight matrix choice," *Nucl. Acids Res.*, 22(22):4673-4680 (1994).
Timmons et al., "Specific interference by ingested dsRNA," *Nature*, 395:854 (1998).
Tomari et al., "Perspective: machines for RNAi," *Genes & Dev.*, 19:517-529 (2005).
Töpfer et al., "Uptake and Transient Expression of Chimeric Genes in Seed-Derived Embryos," *Plant Cell*, 1:133-139 (1989).
Toriyama et al., "Transgenic Rice Plants After Direct Gene Transfer Into Protoplasts," *Bio/Technology*, 6:1072-1074 (1988).
Tran et al., "Control of specific gene expression in mammalian cells by co-expression of long complementary RNAs," *FEBS Lett.*;573(1-3):127-134 (2004).
Turina et al., "Tospoviruses in the Mediterranean Area," *Advances in Virus Research*, 84:403-437 (2012).
Tuschl, "RNA Interference and Small Interfering RNAs," *ChemBiochem*. 2(4):239-245 (2001).
Tuschl, "Expanding small RNA interference," *Nature Biotechnol.*, 20: 446-448 (2002).
Ui-Tei et al., "Guidelines for the selection of highly effective siRNA sequences for mammalian and chick RNA interference," *Nucleic Acids Res.*, 32(3): 936-948 (2004).
Unnamalai et al., "Cationic oligopeptide-mediated delivery of dsRNA for post-transcriptional gene silencing in plant cells," *FEBS Letters*, 566:307-310 (2004).
Unniraman et al., "Alternate Paradigm for Intrinsic Transcription Termination in Eubacteria," *The Journal of Biological Chemistry*, 276(45)(9):41850-41855 (2001).
Urayama et al., "Knock-down of *OsDCL2* in Rice Negatively Affects Maintenance of the Endogenous dsRNA Virus, *Oryza sativa* Endornavirus," *Plant and Cell Physiology*, 51(1):58-67 (2010).
van de Wetering et al., "Specific inhibition of gene expression using a stably integrated, inducible small-interfering-RNA vector," *EMBO Rep*., 4(6):609-615 (2003).
Vasil et al., "Herbicide Resistant Fertile Transgenic Wheat Plants Obtained by Microprojectile Bombardment of Regenerable Embryogenic Callus," *Bio/Technology*,10:667-674 (1992).
Vaucheret, "Post-transcriptional small RNA pathways in plants: mechanisms and regulations," *Genes Dev.*, 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem.*, 67:99-134 (1998).
Vert et al., "An accurate and interpretable model for siRNA efficacy prediction," *BMC Bioinformatics*, 7:520 (2006).
Vionnet et al., "Systemic Spread of Sequence-Specific Transgene RNA Degradation in Plants Is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res*. (*Oxford*), 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Nos. Of Independently Transformed Fertile Barley Plants," *Plant Physiol.*, 104:37-48 (1994).
Wardell, "Floral Induction of Vegetative Plants Supplied a Purified Fraction of Deoxyribonucleic Acid from Stems of Flowering Plants," *Plant Physiol*, 60:885-891 (1977).
Wardell,"Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).

(56) References Cited

OTHER PUBLICATIONS

Welch et al., "Expression of ribozymes in gene transfer systems to modulate target RNA levels," *Curr Opin Biotechnol.* 9(5):486-496 (1998).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated May 8, 2014, in International Application No. PCT/IL2013/050447.
Written Opinion dated Sep. 1, 2014, in Singapore Patent Application No. 201206152-9.
Yin et al., "Production of double-stranded RNA for interference with TMV infection utilizing a bacterial prokaryotic expression system," *Appl. Microbiol. Biotechnol.*, 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "*Agrobacterium*-mediated transformation of *Arabidopsis thaliana* using the floral dip method,"*Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "DEG: a database of essential genes," *Nucleic Acids Res.*, 32:D271-D272 (2004).
Zhang et al., "Transgenic rice plants produced by electroporation-mediated plasmid uptake into protoplasts," *The Plant Cell Rep.*, 7:379-384 (1988).
Zhao et al.,"*Phyllotreta striolata* (Colcoptcra: Chrysomclidac):Argininc kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata,*" *Pest Manag Sci*, 67:175-182 (2010).
Agrios, *Plant Pathology* (Second Edition), 2:466-470 (1978).
Andersson et al., "A novel selection system for potato transformation using a mutated AHAS gene," *Plant Cell Reports*, 22(4):261-267 (2003).
Anonymous, "Agronomy Facts 37: Adjuvants for enhancing herbicide performance," n.p., 1-8, (Jan. 26, 2000), *Web*, (Jan. 21, 2014).
Anonymous, "Do Monsanto have the next big thing?," *Austalian Herbicide Resistance Initiative (AHRI)*, (Apr. 23, 2013) *Web*. (Jan. 19, 2015).
Bai et al., "Naturally Occurring Broad-Spectrum Powdery Mildew Resistance in a Central American Tomato Accession Is Caused by Loss of *Mlo* Function," *MPMI*, 21(1):30-39 (2008).
Bourgeois et al., "Field and producer survey of ACCase resistant wild oat in Manitoba," *Canadian Journal of Plant Science*, 709-715 (1997).
Brugière et al., "Glutamine Synthetase in the Phloem Plays a Major Role in Controlling Proline Production," *The Plant Cell*, 11:1995-2011 (1999).
Busi et al., "Gene flow increases the initial frequency of herbicide resistance alleles in unselectedpopulations," *Agriculture, Ecosystems and Environments*, Elsevier, Amsterdam, NL, 142(3):403-409 (2011).

Campbell et al., "Gene-knockdown in the honey bee mite *Varroa destructor* by a non-invasive approach: studies on a glutathione S-transferase," *Parasites & Vectors*, 3(1):73, pp. 1-10 (2010).
Chang et al., "Cellular Internalization of Fluorescent Proteins via Arginine-rich Intracellular Delivery Peptide in Plant Cells," *Plant Cell Physiol.*, 46(3):482-488 (2005).
Chupp et al., "Chapter 8: White Rust," *Vegetable Diseases and Their Control*, The Ronald Press Company, New York, pp. 267-269 (1960).
Communication pursuant to Article 94(3) EPC dated Jan. 14, 2016, in European Patent Application No. 12 832 415.9.
Communication pursuant to Article 94(3) EPC dated Jun. 26, 2015, as received in European Patent Application No. 11 753 916.3.
Communication pursuant to Article 94(3) EPC dated Oct. 23, 2015, as received in European Patent Application No. 12 831 945.6.
Coticchia et al., "Calmodulin modulates Akt activity in human breast cancer cell lines," *Breast Cancer Res. Treat*, 115:545-560 (2009).
Desai et al., "Reduction in deformed wing virus infection in larval and adult honey bees (*Apis mellifera* L.) by double-stranded RNA ingestion," *Insect Molecular Biology*, 21(4):446-455 (2012).
Dietemann et al., "*Varroa destructor*: research avenues towards sustainable control," *Journal of Apicultural Research*, 51(1):125-132 (2012).
Emery et al., "Radial Patterning of *Arabidopsis* Shoots by Class III HD-ZIP and Kanadi Genes," *Current Biology*, 13:1768-1774 (2003).
Extended European Search Report dated Jan. 20, 2016, in European Patent Application No. 13 794 339.5.
Extended European Search Report dated Feb. 2, 2015, in European Patent Application No. 12 830 932.5.
Extended European Search Report dated Feb. 27, 2015, in European Patent Application No. 12 832 160.1.
Extended European Search Report dated Feb. 3, 2015, in European Patent Application No. 12 831 945.6.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Jun. 29, 2015, in European Patent Application No. 12 831 494.5.
Extended European Search Report dated Mar. 17, 2015, in European Patent Application No. 12 831 684.1.
Extended European Search Report dated Mar. 3, 2015, in European Patent Application No. 12 831 166.9.
Final Office Action dated Nov. 10, 2015, in U.S. Appl. No. 13/612,985.
Final Office Action dated Nov. 7, 2013, in U.S. Appl. No. 13/042,856.
Final Office Action dated Nov. 30, 2015, in U.S. Appl. No. 13/612,948.
First Office Action dated Feb. 2, 2016, in Chinese Patent Application No. 201380039346.6.
First Office Action issued Sep. 9, 2015, in Chinese Patent Application No. 201280055409.2.
First Office Action issued Mar. 12, 2015, in Chinese Patent Application No. 201280053984.9.
First Office Action issued Mar. 2, 2015, in Chinese Patent Application No. 201280054819.5.
First Office Action issued May 27, 2015, in Chinese Patent Application No. 201280054179.8.
First Office Action issued Jul. 7, 2015, in Chinese Patent Application No. 201280054820.8.
First Office Action issued Aug. 31, 2015, in Chinese Patent Application No. 201280053985.3.
Fukunaga et al., "dsRNA with 5' overhangs contributes to endogenous and antiviral RNA silencing pathways in plants," *The EMBO Journal*, 28(5):545-555 (2009).
Gao et al., "Down-regulation of acetolactate synthase compromises 01-1-mediated resistance to powdery mildew in tomato," *BMC Plant Biology*, 14 (2014).

(56) References Cited

OTHER PUBLICATIONS

Garbian et al., "Bidirectional Transfer of RNAi between Honey Bee and *Varroa destructor*: *Varroa* Gene Silencing Reduces *Varroa* Population," 8(12):1-9:e1003035 (2012).
Gressel et al., "A strategy to provide long-term control of weedy rice while mitigating herbicide resistance transgene flow, and its potential use for other crops with related weeds," *Pest Manag Sci*, 65(7):723-731 (2009).
Harrison et al., "Does Lowering Glutamine Synthetase Activity in Nodules Modigy Nitrogen Metabolism and Growth of *Lotus japonicus?*," *Plant Physiology*, 133:253-262 (2003).
International Preliminary Report on Patentability (Chapter II) mailed Jul. 24, 2015, in International Application No. PCT/US2014/047204.
International Search Report and Written Opinion mailed Feb. 23, 2015, in International Application No. PCT/US2014/063832.
International Search Report and Written Opinion mailed Jul. 8, 2015, in International Application No. PCT/US2015/011408.
International Search Report and Written Opinion mailed Mar. 26, 2015, in International Application No. PCT/US2014/069353.
International Search Report and Written Opinion mailed Nov. 24, 2015, in International Application No. PCT/US2015/037522.
International Search Report and Written Opinion mailed Nov. 27, 2015, in International Application No. PCT/US2015/037015.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Jofre-Garfias et al., "*Agrobacterium*-mediated transformation of Amaranthus *hypochondriacus*: light- and tissue-specific expression of a pea chlorophyll a/b-binding protein promoter," *Plant Cell Reports*, 16:847-852 (1997).
Khan et al., "Matriconditioning of Vegetable Seeds to Improve Stand Establishment in Early Field Plantings," *J. Amer. Soc. Hort. Sci.*, 117(1):41-47 (1992).
Kim et al., "Synthetic dsRNA Dicer substrates enhance RNAi potency and efficacy," *Nature Biotechnology*, 23(2):222-226 (2005).
Lein et al., "Target-based discovery of novel herbicides," *Current Opinion in Plant Biology*, 7:219-225 (2004).
Leopold et al., "Chapter 4: Moisture as a Regulator of Physiological Reaction in Seeds," *Seed Moisture, CSSA Special Publication No. 14*, pp. 51-69 (1989).
Lermontova et al., "Reduced activity of plastid protoporphyrinogen oxidase causes attenuated photodynamic damage during high-light compared to low-light exposure," *The Plant Journal*, 48(4):499-510 (2006).
MacKenzie et al., "Transgenic *Nicotiana debneyii* expressing viral coat protein are resistant to potato virus S infection," *Journal of General Virology*, 71:2167-2170 (1990).
Maori et al., "IAPV, a bee-affecting virus associated with Colony Collapse Disorder can be silenced by dsRNA ingestion," *Insect Molecular Biology*, 18(1):55-60 (2009).
Molina et al., "Inhibition of protoporphyrinogen oxidase expression in *Arabidopsis* causes a lesion-mimic phenotype that induces systemic acquired resistance," *The Plant Journal*, 17(6):667-678 (1999).
Non-Final Office Action dated Apr. 11, 2013, in U.S. Appl. No. 13/042,856.
Non-Final Office Action dated Aug. 12, 2015, in U.S. Appl. No. 13/612,936.
Non-Final Office Action dated Aug. 13, 2015, in U.S. Appl. No. 13/612,929.
Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Mar. 30, 2015, in U.S. Appl. No. 13/583,302.
Non-Final Office Action dated May 15, 2015, in U.S. Appl. No. 14/608,951.
Non-Final Office Action dated May 22, 2015, in U.S. Appl. No. 13/612,985.
Nord-Larsen et al., "Cloning, characterization and expression analysis of tonoplast intrinsic proteins and glutamine synthetase in ryegrass (*Lolium perenne* L.)," *Plant Cell Reports*, 28(10):1549-1562 (2009).
Notice of Allowance dated Oct. 5, 2015, in U.S. Appl. No. 13/583,302.
Office Action dated Jul. 23, 2015, in Ukrainian Patent Application No. 201211548.
Office Action issued on Oct. 5, 2015, in Eurasian Patent Application No. 201201264/28.
Orbovićet al., "Foliar-Applied Surfactants and Urea Temporarily Reduce Carbon Assimilation of Grapefruit Leaves," *J. Amer. Soc. Hort. Sci.*, 126(4):486-490 (2001).
Ouellet et al., "Members of the Acetohydroxyacid Synthase Muligene Family of *Brassica Napus* Have Divergent Patterns of Expression," *The Plant Journal*, Blackwell Scientific Publications, Oxford, GB, 2(3):321-330 (1992).
Partial Supplementary European Search Report dated Mar. 2, 2015, in European Patent Application No. 12 831 494.5.
Pratt et al., "Amaranthus rudis and A. tuberculatus, One Species or Two?, *Journal of the Torrey Botanical Society*," 128(3):282-296 (2001).
Restriction Requirement dated Apr. 21, 2015, in U.S. Appl. No. 13/612,954.
Restriction Requirement dated Feb. 12, 2015, in U.S. Appl. No. 13/612,985.
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 21, 2014, in U.S. Appl. No. 13/583,302.
Riggins et al., "Characterization of de novo transcriptome for waterhemp (*Amaranthus tuberculatus*) using GS-FLX 454 pyrosequencing and its application for studies of herbicide target-site genes," *Pest Manag. Sci.*, 66:1042-1052 (2010).
Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Schweizer et al., "Double-stranded RNA interferes with gene function at the single-cell level in cereals," *The Plant Journal*, 24(6):895-903 (2000).
Senthil-Kumar et al., "A systematic study to determine the extent of gene silencing in Nicotiana benthamiana and other Solanaceae species when heterologous gene sequences are used for virus-induced gene silencing," *New Phytologist*, 176:782-791 (2007).
Snead et al., "Molecular basis for improved gene silencing by Dicer substrate interfering RNA compared with other siRNA variants," *Nucleic Acids Research*, 41(12):6209-6221 (2013).
Stevens et al., "New Formulation Technology—Silwet® Organosilicone Surfactants Have Physical and Physiological Properties Which Enhance the Performance of Sprays," *Proceedings of the 9th Australian Weeds Conference*, pp. 327-331 (1990).
Street, "Why is DNA (and not RNA) a stable storage form for genetic information?," *Biochemistry Revisited*, pp. 1-4 (2008).

(56) References Cited

OTHER PUBLICATIONS

Sutton et al., "Activity of mesotrione on resistant weeds in maize," *Pest Manag. Sci.*, 58:981-984 (2002).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," *The Physiology of Vegetable Crops*, pp. 1-36 (1997).
Temple et al., "Can glutamine synthetase activity levels be modulated in transgenic plants by the use of recombinant DNA technology?" *Transgenic Plants and Plant Biochemistry*, 22(4):915-920 (1994).
Temple et al., "Down-regulation of specific members of the glutamine synthetase gene family in Alfalfa by antisense RNA technology," *Plant Molecular Biology*, 37:535-547 (1998).
Tranel et al., "Resistance of weeds to ALS-inhibiting herbicides: what have we learned?," *Weed Science*, 50:700-712 (2002).
Tsugawa et al., "Efficient transformation of rice protoplasts mediated by a synthetic polycationic amino polymer," *Theor Appl Genet*, 97:1019-1026 (1998).
Vermeulen et al., "The contributions of dsRNA structure to Dicer specificity and efficiency," *RNA*, 11(5):674-682 (2005).
Wang et al., "Foliar uptake of pesticides-Present status and future challenge," ScienceDirect, 87:1-8 (2007).
Xu et al., Characterization and Functional Analysis of the Calmodulin-Binding Domain of Rac 1 GTPase, *Plos One*, 7(8)1-12:e42975 (2012).
Agricultural Chemical Usage 2006 Vegetables Summary, Agricultural Statistics Board, NASS, USDA, pp. 1-372 (2007).
Al-Kaff et al., "Plants rendered herbicide-susceptible by cauliflower mosaic virus—elicited suppression of a 35S promoter-regulated transgene," *Nature Biotechnology*, 18:995-999 (2000).
Andersen el al., "Delivery of siRNA from lyophilized polymeric surfaces," *Biomaterials*, 29:506-512 (2008).
Bachman et al.,"Characterization of the spectrum of insecticidal activity of a double-stranded RNA with targeted activity against Western Corn Rootworm (*Diabrotica virgifera virgifera* LeConte)," *Transgenic Res.*, pp. 1-16 (2013).
Balibrea et al., "Extracellular Invertase is an Essential Component of Cytokinin-Mediated Delay of Senescence," *The Plant Cell*, 16(5):1276-1287 (2004).
Bart et al., "A novel system for gene silencing using siRNAs in rice leaf and stem-derived protoplasts," *Plant Methods*, 2(13):1-9 (2006).
Basu et al., "Weed genomics: new tools to understand weed biology," *TRENDS in Plant Science*, 9(8):391-398 (2004).
Busch et al., "RNAi for discovery of novel crop protection products," *Pflanzenschutz-Nachrichten Bayer*, 58(1):34-50 (2005).
Chabannes et al., "In situ analysis of lignins in transgenic tobacco reveals a differential impact of individual transformations on the spatial patterns of lignin deposition at the cellular and subcellular levels," *The Plant Journal*, 28(3):271-282 (2001).
Chen et al., "Transfection and Expression of Plasmid DNA in Plant Cells by an Arginine-Rich Intracellular Delivery Peptide without Protoplast Preparation," *FEBS Letters* 581, pp. 1891-1897 (2007).
Colliver et al., "Differential modification of flavonoid and isoflavonoid biosynthesis with an antisense chalcone synthase construct in transgenic *Lotus corniculatus,"* *Plant Molecular Biology*, 35:509-522 (1997).
Communication pursuant to Article 94(3) EPC dated Mar. 18, 2016, in European Patent Application No. 12 832 160.1.
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Concise Descriptions of Relevance filed by a third party on Nov. 29, 2012, in U.S. Appl. No. 13/042,856.
Dalakouras et al., "Induction of Silencing in Plants by High-Pressure Spraying of In vitro-Synthesized Small RNAs," *Frontiers in Plant Science*, 7(1327):1-5 (2016).
Dawson et al., "cDNA cloning of the complete genome of tobacco mosaic virus and production of infectious transcripts," *Proc. Natl. Acad. Sci. USA*, 83:1832-1836 (1986).
Extended European Search Report dated Sep. 29, 2016, in European Patent Application No. 14778840.0.
Fassler et al., "Blast Glossary," NLM Citation, National Center for Biotechnology Information, pp. 1-9 (2011).
Feuillet et al., "Crop genome sequencing: lessons and rationales," *Trends Plant Sci.*, 16:77-88 (2011).
Final Office Action dated Apr. 7, 2016, in U.S. Appl. No. 13/619,980.
Final Office Action dated Feb. 17, 2016, in U.S. Appl. No. 13/612,929.
Final Office Action dated Feb. 4, 2016, in U.S. Appl. No. 13/612,936.
Final Office Action dated Jun. 30, 2016, in U.S. Appl. No. 13/901,326.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Sep. 9, 2016, in U.S. Appl. No. 13/612,954.
Final Office Action dated Nov. 19, 2015, in U.S. Appl. No. 13/612,941.
Final Office Action dated Nov. 10, 2016, in U.S. Appl. No. 13/583,302.
Final Office Action dated Sep. 9, 2016, in U.S. Appl. No. 14/608,951.
Final Office Action dated Sep. 9, 2016, in U.S. Appl. No. 14/603,347.
Final Office Action dated Oct. 20, 2016, in U.S. Appl. No. 14/480,199.
Final Office Action dated Oct. 22, 2015, in U.S. Appl. No. 14/608,951.
Fraley et al., "Liposome-mediated delivery of tobacco mosaic virus RNA into tobacco protoplasts: A sensitive assay for monitoring liposome-protoplast interactions," *Proc Natl Acad Sci U S A.*, 79(6): 1859-1863 (1982).
Gan et al., "Inhibition of Leaf Senescence by Autoregulated Production of Cytokinin," *Science*, 270:1986-1988 (1995).
Gao et al., "Nonviral Methods for siRNA Delivery," *Molecular Pharmaceutics*, 6(3):651 -658 (2008).
GenBank Accession No. CB377464, "CmaE1_37_J02_T3 Cowpea weevil larvae Lambda Zap Express Library Callosobruchus maculatus cDNA, mRNA sequence," (2007).
GenBank Accession No. EW765249, "ST020010B10C12 Normalized and subtracted western corn rootworm female head cDNA library Diabrotica virgifera virgifera cDNA clone STO20010B10C12 5-, mRNA sequence," (2007).
GenBank Accession No. EW771198, "ST020010B10C12 Normalized and subtracted western corn rootworm female head cDNA library Diabrotica virgifera virgifera cDNA clone STO20010B10C12 5-, mRNA sequence," (2007).
GenBank Accession No. GU120406, "Chrysomela tremulae ribosomal protein L7 (RpL7) mRNA, complete cds" (2009).
GenBank Accession No. HD315444, "Sequence 192160 from Patent EP2213738" (2010).
GenBank Accession No. Q4GXM3_BIPLU, "Ribosomal protein L7e" (2006).
GenBank Accession No. U87257.1, "Daucus carota 4-hydroxyphenylpyruvate dioxygenase mRNA, complete cds" (1997).
GenBank Accession No. XM_014456745.1, Predicted: Myotis lucifugus ribonucleoprotein, PTB-binding 2 (RAVER2), transcript variant X3, mRNA,: (2015).

(56) References Cited

OTHER PUBLICATIONS

GenBank Accession No. Y08611.1, "P.sativum mRNA for dihydropterin pyrophosphokinase/dihydropteroate synthase." (2006).
Gossamer Threads, Compendium of Herbicide Adjuvants: Organo-Silicone Surfactant, p. 1-4 (1998).
Gudkov, "Minireview: The L7/L12 ribosomal domain of the ribosome: structural and functional studies," *FEBS Letters*, 407:253-256 (1997).
Hajirezaei et al., "Impact of elevated cytosolic and apoplastic invertase activity on carbon metabolism during potato tuber development," *Journal of Experimental Botany*, 51:439-445 (2000).
Heffer et al., "Rapid isolation of gene homologs across taxa: Efficient identification and isolation of gene orthologs from non-model organism genomes, a technical report," *EvoDevo Journal*, 2(7):1-5 (2011).
Holtra et al., "Assessment of the Physiological Condition of *Salvinia Natans* L. Exposed to Copper(II) Ions," *Environ. Protect. Eng.*, 41:147-158 (2015).
International Preliminary Report on Patentability dated Sep. 11, 2012, in International Application No. PCT/US2011/027528.
International Rice Genome Sequencing Project, The map-based sequence of the rice genome, *Nature*, 436(11):793-800 (2005).
International Search Report and Written Opinion mailed May 26, 2016, in International Application No. PCT/US2016/014344.
Jin et al., "Posttranslational Elevation of Cell Wall Invertase Activity by Silencing its Inhibitor in Tomato Delays Leaf Senescence and Increases Seed Weight and Fruit Hexose Level," *The Plant Cell*, 21:2072-2089 (2009).
Kaloumenos et al., "Identification of a Johnsongrass (*Sorghum halepense*) Biotype Resistant to ACCase-Inhibiting Herbicides in Northern Greece," *Weed Technol*, 23:470-476 (2009).
Kambiranda et al., "Relationship Between Acid Invertase Activity and Sugar Content in Grape Species," *Journal of Food Biochemistry*, 35:1646-1652 (2011).
Kim et al., "Optimization of Conditions for Transient Agrobacterium-Mediated Gene Expression Assays in Arabidopsis," *Plant Cell Reports*, 28:1159-1167 (2009).
Kirkwood, "Herbicides and Plants," *Botanical Journal of Scotland*, 46(3):447-462 (1993).
Knudsen, "Promoter2.0: for the recognition of PolI promoter sequences," *Bioniformatics*, 15(5):356-361 (1999).
Liu et al., "Identification and Application of a Rice Senescence-Associated Promoter," *Plant Physiology*, 153:1239-1249 (2010).
Liu, "Influence of Sugars on the Foliar Uptake of Bentazone and Glyphosate," *New Zealand Plant Protection*, 55:159-162 (2002).
Luque el al., "Water Permeability of Isolated Cuticular Membranes: A Structural Analysis," *Archives of Biochemistry and Biophysics*, 317(2):417-422 (1995).
Migge et al., "Greenhouse-grown conditionally lethal tobacco plants obtained by expression of plastidic glutamine synthetase antisense RNA may contribute to biological safety," *Plant Science* 153:107-112 (2000).
Mora et al., "How Many Species Are There on Earth and in the Ocean?," *PLOS Biol.*, 9(8):e100127, p. 1-8 (2011).
Mount et al., "Gene and Metabolite Regulatory Network Analysis of Early Developing Fruit Tissues Highlights New Candidate Genes for the Control of Tomato Fruit Composition and Development," *Plant Physiology*, 149:1505-1528 (2009).
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Apr. 29, 2016, in U.S. Appl. No. 13/583,302.
Non-Final Office Action dated Aug. 10, 2016, in U.S. Appl. No. 13/612,995.
Non-Final Office Action dated Nov. 9, 2016, in U.S. Appl. No. 14/901,003.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Dec. 17, 2015, in U.S. Appl. No. 14/532,596.
Non-Final Office Action dated Feb. 10, 2016, in U.S. Appl. No. 13/901,326.
Non-Final Office Action dated Feb. 23, 2016, in U.S. Appl. No. 14/603,347.
Non-Final Office Action dated Feb. 23, 2016, in U.S. Appl. No. 14/608,951.
Non-Final Office Action dated Mar. 1, 2016, in U.S. Appl. No. 13/612,954.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 4, 2015, in U.S. Appl. No. 13/612,995.
Nookaraju et al., "Molecular approaches for enhancing sweetness in fruits and vegetables," *Scientia Horticulture*, 127:1-15 (2010).
Notice of Allowance dated Apr. 11, 2016, in U.S. Appl. No. 13/612,985.
Notice of Allowance dated Apr. 19, 2016, in U.S. Appl. No. 13/612,941.
Notice of Allowance dated Apr. 20, 2016, in U.S. Appl. No. 13/612,948.
Notice of Allowance dated Feb. 23, 2015, in U.S. Appl. No. 13/042,856.
Notice of Allowance dated Jun. 2, 2015, in U.S. Appl. No. 13/042,856.
Office Action dated Apr. 13, 2016, in Chinese Patent Application No. 201280053985.3.
Office Action dated Jul. 18, 2016, in Indonesian Patent Application No. W00201203610.
Office Action dated Sep. 5, 2016, in Ukrainian Patent Application No. a 2014 03846.
Office Action dated Aug. 25, 2016, in Eurasian Patent Application No. 201201264.
Office Action dated Jun. 20, 2016, in Chinese Patent Application No. 201280054819.5.
Office Action dated Jun. 24, 2016, in Chinese Patent Application No. 201280053984.9.
Patent Examination Report No. 1 dated Feb. 8, 2016, in Australian Patent Application No. 2014262189.
Patent Examination Report No. 1 dated Jun. 17, 2016, in Australian Patent Application No. 2012308659.
Patent Examination Report No. 1 dated Jun. 17, 2016, in Australian Patent Application No. 2012308660.
Promoter Prediction for SEQ ID No: 1702 from 13/612929/MK/, Promoter 2.0 Prediction Results, pp. 1-4 (2016).
Promoter Prediction for SEQ ID No:4 from 13/612995/MK/, Promoter 2.0 Prediction Results, pp. 1-3 (2016).
Promoter Prediction for SEQ ID No: 7 from 13/612936/MK/, Promoter 2.0 Prediction Results, pp. 1-2 (2016).
Promoter Prediction for SEQ ID No: 8 from 13/612,925/MK/, Promoter 2.0 Prediction Results, pp. 1-6 (2016).
Restriction Requirement dated Jul. 15, 2016, in U.S. Appl. No. 14/143,748.
Restriction Requirement dated Jul. 18, 2016, in U.S. Appl. No. 14/143,836.
Restriction Requirement dated Oct. 13, 2016, in U.S. Appl. No. 14/206,707.
Restriction Requirement dated Oct. 28, 2015, in U.S. Appl. No. 14/603,347.
Restriction Requirement dated Sep. 2, 2015, in U.S. Appl. No. 14/532,596.

(56) References Cited

OTHER PUBLICATIONS

Roberts, "Fast-track applications: The potential for direct delivery of proteins and nucleic acids to plant cells for the discovery of gene function," *Plant Methods*, 1(12):1-3 (2005).
Robson et al., "Leaf senescence is delayed in maize expressing the Agrobacterium IPT gene under the control of a novel maize senescence-enhanced promoter," *Plant Biotechnology Journal*, 2:101-112 (2004).
Roitsch et al., "Extracellular invertase: key metabolic enzyme and PR protein," *Journal of Experimental Botany*, 54(382):513-524 (2003).
Roitsch et al., "Function and regulation of plant invertases: sweet sensations," *Trades in Plant Science*, 9(12):606-613 (2004).
Ruan et al., "Suppression of Sucrose Synthase Gene Expression Represses Cotton Fiber Cell Initiation, Elongation, and Seed Development," *The Plant Cell*, 15:952-964 (2003).
Salanenka et al., "Seedcoat Permeability: Uptake and Post-germination Transport of Applied Model Tracer Compounds," *HortScience*, 46(4):622-626 (2011).
Schönherr, "Water Permeability of Isolated Cuticular Membranes: The Effect of pH and Cations on Diffusion, Hydrodynamic Permeability and Size of Polar Pores in the Cutin Matrix," *Planta*, 128:113-126 (1976).
Scott et al., Botanical Insecticides for Controlling Agricultural Pests: Piperamides and the Colorado Potato Beetle *Leptinotarsa decemlineata* Say (Coleoptera: Chrysomelidae), *Archives of Insect Biochemistry and Physiology*, 54:212-225 (2003).
Second Office Action dated Feb. 25, 2016, in Chinese Patent Application No. 201280054179.8.
Second Office Action dated Mar. 4, 2016, in Chinese Patent Application No. 201280054820.8.
Shintani et al., "Antisense Expression and Overexpression of Biotin Carboxylase in Tobacco Leaves," *Plant Physiol.*, 114:881-886 (1997).
Showalter, "Structure and Function of Plant Cell Wall Proteins," *The Plant Cell*, 5:9-23 (1993).
Song et al., "Herbicide," *New Heterocyclic Pesticide*, Chemical Industry Press, 354-356 (2011).

Stevens, "Organosilicone Surfactants as Adjuvants for Agrochemicals," *Journal of Pesticide Science*, 38:103-122 (1993).
Tang et al., "Efficient delivery of small interfering RNA to plant cells by a nanosecond pulsed laser-induced stress wave for post-transcriptional gene silencing," *Plant Science*, 171:375-381 (2006).
Tenllado et al., "Double-Stranded RNA-Mediated Interference with Plant Virus Infection," *Journal of Virology*, '75(24):12288-12297 (2001).
Thomas et al., "Size constraints for targeting post-transcriptional gene silencing and for RNA-directed methylation in *Nicotiana benthamiana* using a potato virus X vector," *The Plant Journal*, 25(4):417-425 (2001).
Tomlinson et al., "Evidence that the hexose-to-sucrose ratio does not control the switch to storage product accumulation in oilseeds: analysis of tobacco seed development and effects of overexpressing apoplastic invertase," *Journal of Experimental Botany*, 55(406):2291-2303 (2004).
Unniraman et al., "Conserved Economics of Transcription Termination in Eubacteria," *Nucleic Acids Research*, 30(3):675-684 (2002).
Widholm et al., "Glyphosate selection of gene amplification in suspension cultures of 3 plant species," *Phyisolagia Plantarum*, 112:540-545 (2001).
Wiesman et al., "Novel cationic vesicle platform derived from vernonia oil for efficient delivery of DNA through plant cuticle membranes," *Journal of Biotechnology*, 130:85-94 (2007).
Wild Carrot, Noxious Weed Control Board (NWCB) of Washington State (2010) <www.nwcb.wa.gov/detail.asp?weed=46>.
Wool et al., "Structure and evolution of mammalian ribosomal proteins," *Biochem. Cell Biol.*, 73:933-947 (1995).
Written Opinion dated Apr. 7, 2016, in Singapore Patent Application No. 201206152-9.
Zhang et al., "Chapter 10: New Characteristics of Pesticide Research & Development," *New Progress of the world agriculture chemicals*, p. 209 (2010).
Zhang et al., "Development and Validation of Endogenous Reference Genes for Expression Profiling of Medaka (*Oryzias latipes*) Exposed to Endocrine Disrupting Chemicals by Quantitative Real-Time RT-PCR," *Toxicological Sciences*, 95(2):356-368 (2007).

* cited by examiner

COMPOSITIONS AND METHODS FOR CONTROLLING LEPTINOTARSA

CROSS-REFERENCE TO RELATED APPLICATIONS AND INCORPORATION OF SEQUENCE LISTINGS

This application claims priority to U.S. Provisional Patent Application No. 61/856,137 filed 19 Jul. 2013, U.S. Provisional Patent Application No. 61/899,000 filed 1 Nov. 2013, and U.S. Provisional Patent Application No. 61/980,800 filed 17 Apr. 2014, which are incorporated by reference in their entirety herein. The sequence listings contained in the files "40-21_60191_A.txt" (2,291 kilobytes, created on 19 Jul. 2013, filed with U.S. Provisional Patent Application No. 61/856,137 on 19 Jul. 2013), "40-21_60191_0001US_ST25.txt" (2,322 kilobytes, created on 30 Oct. 2013, filed with U.S. Provisional Patent Application No. 61/899,000 on 1 Nov. 2013), and "40-21_60191_0002_US_ST25.txt" (2,338 kilobytes, created on 17 Apr. 2014, filed with U.S. Provisional Patent Application No. 61/980,800 on 17 Apr. 2014) are incorporated by reference in their entirety herein. The sequence listing contained in the file "40-2160191_0003_ST25_new.txt" (2,532,856 bytes, created on 17 Jul. 2014) is filed herewith and incorporated by reference in its entirety herein.

FIELD

Methods for controlling invertebrate pest infestations, particularly in plants, as well as compositions, polynucleotides, and recombinant DNA constructs useful in such methods are disclosed. More specifically, this invention is related to polynucleotides and methods of use thereof for modifying the expression of genes in an insect pest, particularly through RNA interference. Pest species of interest include *Leptinotarsa* species, especially those that infest crop plants.

BACKGROUND

Commercial crops are often the targets of attack by invertebrate pests such as insects. Compositions for controlling insect infestations in plants have typically been in the form of chemical insecticides. However, there are several disadvantages to using chemical insecticides. For example, chemical insecticides are generally not selective, and applications of chemical insecticides intended to control insect pests in crop plants can exert their effects on non-target insects and other invertebrates as well. Chemical insecticides often persist in the environment and can be slow to degrade, thus potentially accumulating in the food chain. Furthermore the use of persistent chemical insecticides can result in the development of resistance in the target insect species. Thus there has been a long felt need for more environmentally friendly methods for controlling or eradicating insect infestation on or in plants, i.e., methods which are species-selective, environmentally inert, non-persistent, and biodegradable, and that fit well into pest resistance management schemes.

RNA interference (RNAi, RNA-mediated gene suppression) is another approach used for pest control. In invertebrates, RNAi-based gene suppression was first demonstrated in nematodes (Fire et al., (1998) *Nature*, 391:806-811; Timmons & Fire (1998) *Nature*, 395:854). Subsequently, RNAi-based suppression of invertebrate genes using recombinant nucleic acid techniques has been reported in a number of species, including agriculturally or economically important pests from various insect and nematode taxa.

*Leptinotarsa* spp. form a genus including a number of species that infest commercially important plants, including many solanaceous plants (e.g., potato, tomato, eggplant, peppers, tobacco, and petunia). For example, *Leptinotarsa decemlineata* (Colorado potato beetle, CPB) is an early- to mid-season pest affecting solanaceous plants such as potato. Colorado potato beetles primarily feed on above-ground portions of the plant, and defoliation leads to lower tuber yields. Methods and compositions for controlling insect pests, in particular *Leptinotarsa* spp. which infest crop plants are desired.

SUMMARY

The present embodiments are related to control of *Leptinotarsa* species, especially those that are economically or agriculturally important pests. In various embodiments, the *Leptinotarsa* species is at least one selected from the group consisting of *Leptinotarsa behrensi, Leptinotarsa collinsi, Leptinotarsa decemlineata* (Colorado potato beetle), *Leptinotarsa defecta, Leptinotarsa haldemani* (Haldeman's green potato beetle), *Leptinotarsa heydeni, Leptinotarsa juncta* (false potato beetle), *Leptinotarsa lineolata* (burrobrush leaf beetle), *Leptinotarsa peninsularis, Leptinotarsa rubiginosa, Leptinotarsa texana, Leptinotarsa tlascalana, Leptinotarsa tumamoca*, and *Leptinotarsa typographica*. In specific embodiments, the *Leptinotarsa* species is at least one selected from the group consisting of *Leptinotarsa decemlineata* (Colorado potato beetle), *Leptinotarsa juncta* (false potato beetle), *Leptinotarsa haldemani* (Haldeman's green potato beetle), and *Leptinotarsa lineolata* (burrobrush leaf beetle).

The compositions and methods described herein include recombinant polynucleotide molecules, such as recombinant DNA constructs for making transgenic plants resistant to infestation by *Leptinotarsa* species, and single- or double-stranded DNA or RNA molecules, referred to herein as "triggers", that are useful for controlling or preventing infestation of a plant by that *Leptinotarsa* species. In some embodiments, polynucleotide triggers are provided as topically applied agents for controlling or preventing infestation of a plant by a *Leptinotarsa* species. In some embodiments, solanaceous plants with improved resistance to infestation by *Leptinotarsa* species, such as transgenic solanaceous plants (including seeds or propagatable parts such as tubers) expressing a polynucleotide trigger are provided. In some embodiments, solanaceous plants (including seeds or propagatable parts such as tubers) that have been topically treated with a composition comprising a polynucleotide trigger (e.g., solanaceous plants that have been sprayed with a solution of dsRNA molecules) are provided. Also provided are polynucleotide-containing compositions that are topically applied to a *Leptinotarsa* species or to a plant, plant part, or seed to be protected from infestation by a *Leptinotarsa* species.

Several embodiments relate to suppression of a target gene in a *Leptinotarsa* species by a polynucleotide trigger. Some embodiments relate to methods for selecting *Leptinotarsa* target genes that are likely to be effective targets for RNAi-mediated control of a *Leptinotarsa* species. In some embodiments, target genes selected for RNAi-mediated suppression are genes that are non-repetitive and non-redundant in a *Leptinotarsa* species genome, or that have low nucleotide diversity, or that are evolutionarily or functionally constrained to have a more synonymous ($K_s$) than nonsynonymous ($K_a$) nucleotide changes. Provided herein are nucleotide sequences referred to herein as the "Target Gene Sequences Group", which consists of SEQ ID NOs:1-725 and SEQ ID NOs:726-830 and SEQ ID NOs:1087-1094. Also provided are nucleotide sequences referred to herein as the "Trigger Sequences Group", which consists of SEQ ID NOs:831, 842, 849, 898, 910, 925, 928, 931, 932, 937, 938, 940, 941, 942, 943, 944, 945, 947, 948, 949, 950, 951, 952, 955, 956, 957, 958, 960, 961, 964, 966, 967, 968, 969, 970, 971, 973, 976, 978, 979, 982, 983, 985, 987, 988, 989, 991, 992, 994, 995, 996, 997, 999, 1006, 1007, 1008, 1009, 1010, 1013, 1018, 1019, 1020, 1022, 1025, 1029, 1030, 1033, 1035, 1036, 1037, 1038, 1039, 1040, 1041, 1042, 1043, 1045, 1046, 1047, 1049, 1050, 1053, 1054, 1058, 1060, 1061, 1064, 1065, 1066, 1067, 1068, 1070, 1073, 1074, 1075, 1077, 1078, 1080, 1081, 1082, 1084, 1085, 1095, 1096, 1097, 1098, 1099, 1100, 1101, 1102, 1103, 1104, 1105, 1110, 1111, 1112, 1113, and 1114.

In one aspect, a method for controlling a *Leptinotarsa* species infestation of a plant comprising contacting the *Leptinotarsa* species with a polynucleotide comprising at least one segment of 18 or more contiguous nucleotides with a sequence of about 95% to about 100% identity (e.g., a segment of 21 contiguous nucleotides with a sequence of 100% identity) with a corresponding fragment of a DNA having a sequence selected from the group consisting of: the Target Gene Sequences Group, or the DNA complement thereof. In an embodiment, the method for controlling a *Leptinotarsa* species infestation of a plant comprises contacting the *Leptinotarsa* species with a polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the polynucleotide is double-stranded RNA. In some embodiments, the polynucleotide comprises one or more nucleotide sequences selected from the Trigger Sequences Group. In some embodiments, the contacting with a polynucleotide is achieved by topical application of the polynucleotide, or of a composition or solution containing the polynucleotide (e.g., by spraying or dusting or soaking), directly to the *Leptinotarsa* species or to a surface or matrix (e.g., a plant or soil) contacted by the *Leptinotarsa* species. In some embodiments, the contacting with a polynucleotide is achieved by providing a polynucleotide that is ingested by the *Leptinotarsa* species. In some embodiments, the contacting with a polynucleotide is achieved by providing a transgenic plant that expresses to the *Leptinotarsa* species.

Several embodiments relate to a method for controlling a *Leptinotarsa* species infestation of a plant by providing in the diet of a *Leptinotarsa* species an agent comprising a polynucleotide having at least one segment of 18 or more contiguous nucleotides with a sequence of about 95% to about 100% identity (e.g., a segment of 21 contiguous nucleotides with a sequence of 100% identity) with a corresponding fragment of a DNA having a sequence selected from the group consisting of: the Target Gene Sequences Group, or the DNA complement thereof, and wherein the agent functions upon ingestion by the *Leptinotarsa* species to inhibit a biological function within the *Leptinotarsa* species thereby controlling infestation by the *Leptinotarsa* species. In an embodiment, the method for controlling a *Leptinotarsa* species infestation of a plant comprises providing in the diet of the *Leptinotarsa* species a polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the polynucleotide comprises one or more nucleotide sequences selected from the Trigger Sequences Group. In some embodiments, the polynucleotide is double-stranded RNA. In some embodiments, the agent containing the polynucleotide is formulated for application to fields of crop plants, e.g., in sprayable solutions or emulsions, tank mixes, or powders. In some embodiments, the agent is biologically produced, e.g., in the form of a microbial fermentation product or expressed in a transgenic plant cell.

In another aspect, a method of causing mortality or stunting in *Leptinotarsa* species larvae is provided. In some embodiments, at least one RNA comprising at least one silencing element is provided in the diet of a *Leptinotarsa* species larvae wherein ingestion of the RNA by the *Leptinotarsa* species larvae results in mortality or stunting in the *Leptinotarsa* species larvae. In some embodiments, the silencing element is essentially identical or essentially complementary to a fragment of a target gene sequence of the *Leptinotarsa* species larvae, wherein the target gene is selected from the group consisting of the genes in the Target Gene Sequences Group In an embodiment, the method of causing mortality or stunting in larvae of the *Leptinotarsa* species comprises providing in the diet of the larvae at least one polynucleotide comprising at least one silencing element comprising 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the silencing element comprises one or more nucleotide sequences selected from the Trigger Sequences Group. In some embodiments, the polynucleotide is double-stranded RNA. Some embodiments relate to a method of causing mortality or lower fecundity in *Leptinotarsa* species comprising providing in the diet of *Leptinotarsa* species at least one RNA comprising at least one silencing element essentially identical or essentially complementary to a fragment of a target gene sequence of the *Leptinotarsa* species larvae wherein ingestion of the RNA by the *Leptinotarsa* species results in mortality or lower fecundity in the *Leptinotarsa* species. In some embodiments, the target gene is selected from the group consisting of the genes in the Target Gene Sequences Group. In some embodiments, the method causes a decrease in metamorphosis rate or a decrease in feeding activity. In some embodiments, the method is useful for providing plants having increased resistance to infestation by *Leptinotarsa* species.

Several embodiments relate to a method of providing a plant having improved resistance to a *Leptinotarsa* species infestation comprising topically applying to the plant a composition comprising at least one polynucleotide having at least one segment of 18 or more contiguous nucleotides with a sequence of about 95% to about 100% identity (e.g., a segment of 21 contiguous nucleotides with a sequence of 100% identity) with a corresponding fragment of a DNA having a sequence selected from the group consisting of: the Target Gene Sequences Group, or the DNA complement thereof. In an embodiment, the method of providing a plant having improved resistance to a *Leptinotarsa* species infestation comprises topically applying to the plant a composition comprising at least one polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In an embodiment, the method of providing a plant having improved resistance to a *Leptinotarsa* species infestation comprises topically applying to the plant a composition comprising at least one polynucleotide in a manner such that an effective amount of the polynucleotide is ingested by a *Leptinotarsa* species feeding on the plant, the polynucleotide comprising at least 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the polynucleotide comprises one or more nucleotide sequences selected from the Trigger Sequences Group. In some embodiments, the polynucleotide is double-stranded RNA. Several embodiments relate to compositions comprising the polynucleotide, formulated for application to fields of crop plants, e.g., in sprayable solutions or emulsions, tank mixes, or powders.

Several embodiments relate to an insecticidal composition for controlling a *Leptinotarsa* species comprising an insecticidally effective amount of at least one polynucleotide molecule comprising at least one segment of 18 or more contiguous nucleotides that are essentially identical or complementary (e.g., a segment of 21 contiguous nucleotides with a sequence of 100% identity or complementarity) with the corresponding fragment of a DNA having a sequence selected from the group consisting of: the Target Gene Sequences Group, or the DNA complement thereof. In some embodiments, the polynucleotide molecule comprises at least 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the polynucleotide comprises one or more nucleotide sequences selected from the Trigger Sequences Group. In some embodiments, the polynucleotide molecule is a recombinant polynucleotide. In some embodiments, the polynucleotide molecule is RNA. In some embodiments, the polynucleotide molecule is double-stranded RNA. Related embodiments include insecticidal compositions comprising the polynucleotide molecule formulated for application to fields of crop plants, e.g., in sprayable solutions or emulsions, tank mixes, or powders, and optionally comprising one or more additional components, such as a carrier agent, a surfactant, a cationic lipid, an organosilicone, an organosilicone surfactant, a polynucleotide herbicidal molecule, a non-polynucleotide herbicidal molecule, a non-polynucleotide pesticide, a safener, and an insect growth regulator.

Several embodiments relate to a method of providing a plant having improved resistance to a *Leptinotarsa* species infestation comprising expressing in the plant at least one polynucleotide comprising at least one segment of 18 or more contiguous nucleotides that are essentially identical or complementary to (e.g., a segment of 21 contiguous nucleotides with a sequence of 100% identity or complementarity with) the corresponding fragment of a DNA having a sequence selected from the group consisting of: the Target Gene Sequences Group, or the DNA complement thereof. In some embodiments, the polynucleotide comprises one or more nucleotide sequences selected from the Trigger Sequences Group. In some embodiments, the polynucleotide is double-stranded RNA.

Several embodiments relate to a recombinant DNA construct comprising a heterologous promoter operably linked to a DNA element comprising at least one segment of 18 or more contiguous nucleotides with a sequence of about 95% to about 100% identity (e.g., a segment of 21 contiguous nucleotides with a sequence of 100% identity) with the corresponding fragment of a DNA having a sequence selected from the group consisting of: the Target Gene Sequences Group, or the DNA complement thereof. In some embodiments, the DNA element encodes a double-stranded RNA. In some embodiments, the double-stranded RNA comprises one or more nucleotide sequences selected from the Trigger Sequences Group. Related embodiments include a plant chromosome or a plastid or a recombinant plant virus vector or a recombinant baculovirus vector comprising the recombinant DNA construct, or comprising the DNA element without the heterologous promoter.

Several embodiments relate to a transgenic solanaceous plant cell having in its genome a recombinant DNA encoding RNA that suppresses expression of a target gene in a *Leptinotarsa* species that contacts or ingests the RNA, wherein the RNA comprises at least one silencing element having at least one segment of 18 or more contiguous nucleotides complementary to a fragment of a target gene. In some embodiments, the target gene is selected from the the Target Gene Sequences Group. A specific embodiment is a transgenic solanaceous plant cell having in its genome a recombinant DNA encoding RNA for silencing one or more target genes selected from the group consisting of exocyst genes, ribosomal protein genes, and proteosome genes. In some embodiments, the RNA comprises one or more nucleotide sequences selected from the Trigger Sequences Group.

Several embodiments relate to an isolated recombinant RNA molecule that causes mortality or stunting of growth in a *Leptinotarsa* species when ingested or contacted by the *Leptinotarsa* species, wherein the recombinant RNA molecule comprises at least one segment of 18 or more contiguous nucleotides that are essentially complementary to (e.g., a segment of 21 contiguous nucleotides with a sequence of 100% complementarity with) the corresponding of a DNA having a sequence selected from the group consisting of: the Target Gene Sequences Group, or the DNA complement thereof. In some embodiments, the recombinant RNA molecule is double-stranded RNA. Specific embodiments include an isolated recombinant RNA molecule for suppressing expression of a ribosomal protein such as a ribosomal L7 protein or a protein encoded by SEQ ID NO:730, and an isolated recombinant double-stranded RNA molecule having a sequence selected from the group consisting of SEQ ID NO:989, 988, 1104, or 1105.

Several embodiments relate to a method of providing a plant having improved resistance to a *Leptinotarsa* species infestation comprising providing to the plant at least one polynucleotide comprising at least one segment of 18 or more contiguous nucleotides that are essentially identical or complementary to (e.g., a segment of 21 contiguous nucleotides with a sequence of 100% identity or complementarity with) the corresponding fragment of a target gene selected from the Target Gene Sequences Group. In an embodiment, the method of providing a plant having improved resistance to a *Leptinotarsa* species infestation comprises providing to the plant at least one polynucleotide comprising at least one segment that is identical or complementary to at least 21 contiguous nucleotides of a target gene or an RNA transcribed from the target gene, wherein the target gene is selected from the group consisting of: the genes identified in the Target Gene Sequences Group. In some embodiments, the polynucleotide comprises one or more nucleotide sequences selected from the Trigger Sequences Group. In some embodiments, the polynucleotide is double-stranded RNA.

Several embodiments relate to a method for controlling a *Leptinotarsa* species infestation of a plant comprising contacting the *Leptinotarsa* species with a polynucleotide comprising at least one segment of 18 or more contiguous nucleotides that are essentially identical or complementary to (e.g., a segment of 21 contiguous nucleotides with a sequence of 100% identity or complementarity with) the corresponding fragment of equivalent length of a DNA of a target gene selected from the Target Gene Sequences Group. In some embodiments, the polynucleotide is double-stranded RNA. In an embodiment, the method for controlling a *Leptinotarsa* species infestation of a plant comprises contacting the *Leptinotarsa* species with an effective amount of a double-stranded RNA, one strand of which is complementary to at least 21 contiguous nucleotides of a gene that encodes a ribosomal protein, wherein RNA interference is induced and mortality occurs. In some embodiments, the double-stranded RNA comprises one or more nucleotide sequences selected from the Trigger Sequences Group.

Several embodiments relate to a method of selecting target genes for RNAi-mediated silencing from a plant genome or from an animal genome. In various embodiments, the method provides a subset of target genes that are present in single- or low-copy-number (non-repetitive and non-redundant) in a particular genome, or that have low nucleotide diversity, or that have a ratio of synonymous ($K_s$) to nonsynonymous ($K_a$) nucleotide changes where $K_s >> K_a$.

Several embodiments relate to man-made compositions comprising at least one polynucleotide as described herein. In some embodiments, formulations useful for topical application to a plant or substance in need of protection from a *Leptinotarsa* species infestation are provided. In some embodiments, recombinant constructs and vectors useful for making transgenic solanaceous plant cells and transgenic solanaceous plants are provided. In some embodiments, formulations and coatings useful for treating solanaceous plants, solanaceous plant seeds or propagatable parts such as tubers are provided. In some embodiments, commodity products and foodstuffs produced from such solanaceous plants, seeds, or propagatable parts treated with or containing a polynucleotide as described herein (especially commodity products and foodstuffs having a detectable amount of a polynucleotide as described herein) are provided. Several embodiments relate to polyclonal or monoclonal antibodies that bind a protein encoded by a sequence or a fragment of a sequence selected from the Target Gene Sequences Group. Another aspect relates to polyclonal or monoclonal antibodies that bind a protein encoded by a sequence or a fragment of a sequence selected from the Trigger Sequences Group, or the complement thereof. Such antibodies are made by routine methods as known to one of ordinary skill in the art.

In the various embodiments described herein, the plant can be any plant that is subject to infestation by a *Leptinotarsa* species. Of particular interest are embodiments wherein the plant is a solanaceous plant (family Solanaceae). Examples include a plant selected from the group consisting of potato, tomato, and eggplant. Embodiments include those wherein the plant is an ungerminated solanaceous plant seed, a solanaceous plant in a vegetative stage, or a solanaceous plant in a reproductive stage. Embodiments include those wherein the plant is a "seed potato", meaning a potato tuber or piece of potato tuber which can be propagated into new potato plants.

Other aspects and specific embodiments of this invention are disclosed in the following detailed description.

DETAILED DESCRIPTION

Unless defined otherwise, all technical and scientific terms used have the same meaning as commonly understood by one of ordinary skill in the art to which this invention belongs. Where a term is provided in the singular, the inventors also contemplate aspects of the invention described by the plural of that term. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" ($6^{th}$ edition, 2002, McGraw-Hill, New York), or the "Oxford Dictionary of Biology" ($6^{th}$ edition, 2008, Oxford University Press, Oxford and New York). The inventors do not intend to be limited to a mechanism or mode of action. Reference thereto is provided for illustrative purposes only.

Unless otherwise stated, nucleic acid sequences in the text of this specification are given, when read from left to right, in the 5' to 3' direction. One of skill in the art would be aware that a given DNA sequence is understood to define a corresponding RNA sequence which is identical to the DNA sequence except for replacement of the thymine (T) nucleotides of the DNA with uracil (U) nucleotides. Thus, providing a specific DNA sequence is understood to define the exact RNA equivalent. A given first polynucleotide sequence, whether DNA or RNA, further defines the sequence of its exact complement (which can be DNA or RNA), a second polynucleotide that hybridizes perfectly to the first polynucleotide by forming Watson-Crick base-pairs. For DNA:DNA duplexes (hybridized strands), base-pairs are adenine:thymine or guanine:cytosine; for DNA:RNA duplexes, base-pairs are adenine:uracil or guanine:cytosine. Thus, the nucleotide sequence of a blunt-ended double-stranded polynucleotide that is perfectly hybridized (where there "100% complementarity" between the strands or where the strands are "complementary") is unambiguously defined by providing the nucleotide sequence of one strand, whether given as DNA or RNA. By "essentially identical" or "essentially complementary" to a target gene or a fragment of a target gene is meant that a polynucleotide strand (or at least one strand of a double-stranded polynucleotide) is designed to hybridize (generally under physiological conditions such as those found in a living plant or animal cell) to a target gene or to a fragment of a target gene or to the transcript of the target gene or the fragment of a target gene; one of skill in the art would understand that such hybridization does not necessarily require 100% sequence identity or complementarity. A first nucleic acid sequence is "operably" connected or "linked" with a second nucleic acid sequence when the first nucleic acid sequence is placed in a functional relationship with the second nucleic acid sequence. For example, a promoter sequence is "operably linked" to a DNA if the promoter provides for transcription or expression of the DNA. Generally, operably linked DNA sequences are contiguous.

The term "polynucleotide" commonly refers to a DNA or RNA molecule containing multiple nucleotides and generally refers both to "oligonucleotides" (a polynucleotide molecule of 18-25 nucleotides in length) and longer polynucleotides of 26 or more nucleotides. Polynucleotides also include molecules containing multiple nucleotides including non-canonical nucleotides or chemically modified nucleotides as commonly practiced in the art; see, e.g., chemical modifications disclosed in the technical manual "RNA Interference (RNAi) and DsiRNAs", 2011 (Integrated DNA Technologies Coralville, Iowa). Generally, polynucleotides as described herein, whether DNA or RNA or both, and whether single- or double-stranded, include at least one segment of 18 or more contiguous nucleotides (or, in the case of double-stranded polynucleotides, at least 18 contiguous base-pairs) that are essentially identical or complementary to a fragment of equivalent size of the DNA of a target gene or the target gene's RNA transcript. Throughout this disclosure, "at least 18 contiguous" means "from about 18 to about 10,000, including every whole number point in between". Thus, embodiments of this invention include oligonucleotides having a length of 18-25 nucleotides (18-mers, 19-mers, 20-mers, 21-mers, 22-mers, 23-mers, 24-mers, or 25-mers), or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e.g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where a polynucleotide is double-stranded, its length can be similarly described in terms of base pairs.

The polynucleotides described herein can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments include those wherein the polynucleotide is selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used. In some embodiments, the polynucleotide is double-stranded RNA of a length greater than that which is typical of naturally occurring regulatory small RNAs (such as endogenously produced siRNAs and mature miRNAs). In some embodiments, the polynucleotide is double-stranded RNA of at least about 30 contiguous base-pairs in length. In some embodiments, the polynucleotide is double-stranded RNA with a length of between about 50 to about 500 base-pairs. In some embodiments, the polynucleotide can include components other than standard ribonucleotides, e.g., an embodiment is an RNA that comprises terminal deoxyribonucleotides.

In various embodiments, the polynucleotide described herein comprise naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or one or more terminal dideoxyribonucleotides or synthetic polynucleotides consisting mainly of deoxyribonucleotides but with one or more terminal dideoxyribonucleotides. In certain embodiments, the polynucleotide comprises non-canonical nucleotides such as inosine, thiouridine, or pseudouridine. In certain embodiments, the polynucleotide comprises chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e.g., fluorescein or rhodamine) or other label (e.g., biotin).

Several embodiments relate to a polynucleotide comprising at least one segment of 18 or more contiguous nucleotides with a sequence of about 95% to about 100% identity with a fragment of equivalent length of a DNA or target gene having a sequence selected from the Target Gene Sequences Group or the DNA complement thereof. In some embodiments, the contiguous nucleotides number at least 18, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In some embodiments, the polynucleotide comprises at least one segment of at least 21 contiguous nucleotides with a sequence of 100% identity with a fragment of equivalent length of a DNA or target gene having a sequence selected from the Target Gene Sequences Group or the DNA complement thereof. In some embodiments, the polynucleotide is a double-stranded nucleic acid (e.g., dsRNA) with one strand comprising at least one segment of at least 21 contiguous nucleotides with 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In some embodiments, each segment contained in the polynucleotide is of a length greater than that which is typical of naturally occurring regulatory small RNAs, for example, each segment is at least about 30 contiguous nucleotides (or base-pairs) in length. In some embodiments, the total length of the polynucleotide, or the length of each segment contained in the polynucleotide, is less than the total length of the DNA or target gene having a sequence selected from the Target Gene Sequences Group. In some embodiments, the total length of the polynucleotide is between about 50 to about 500 nucleotides (for single-stranded polynucleotides) or base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Embodiments include those in which the polynucleotide expressed in the plant is an RNA comprising a segment having a sequence selected from the group consisting of: SEQ ID NOs:831-1085, 1095-1104, and 1110-1114, or the complement thereof, or is an RNA hairpin encoded by a sequence selected from the group consisting of SEQ ID NOs:1105-1109. In some embodiments, the polynucleotide is expressed in a plant. In some embodiments, the polynucleotide is topically provided to the surface of a plant or *Leptinotarsa* species.

Several embodiments relate to polynucleotides that are designed to modulate expression by inducing regulation or suppression of a *Leptinotarsa* species target gene. In some embodiments, the polynucleotides are designed to have a nucleotide sequence essentially identical or essentially complementary to the nucleotide sequence of a *Leptinotarsa* species target gene or cDNA (e.g., The Target Gene Sequences Group) or to the sequence of RNA transcribed from a *Leptinotarsa* species target gene, which can be coding sequence or non-coding sequence. These effective polynucleotide molecules that modulate expression may be referred to herein as a "polynucleotide", "polynucleotide trigger", "trigger", or "triggers".

Effective polynucleotides of any size can be used, alone or in combination, in the various methods and compositions described herein. In some embodiments, a single polynucleotide trigger is used to make a composition (e.g., a composition for topical application, or a recombinant DNA construct useful for making a transgenic plant). In other embodiments, a mixture or pool of different polynucleotide triggers is used; in such cases the polynucleotide triggers can be for a single target gene or for multiple target genes.

As used herein, the term "isolated" refers to separating a molecule from other molecules normally associated with it in its native or natural state. The term "isolated" thus may refer to a DNA molecule that has been separated from other DNA molecule(s) which normally are associated with it in its native or natural state. Such a DNA molecule may be present in a recombined state, such as a recombinant DNA molecule. Thus, DNA molecules fused to regulatory or coding sequences with which they are not normally associated, for example as the result of recombinant techniques, are considered isolated, even when integrated as a transgene into the chromosome of a cell or present with other DNA molecules.

As used herein, the term "Target Gene Sequences Group" refers to the group of sequences consisting of SEQ ID NOs:1-725 and SEQ ID NOs:726-830 and SEQ ID NOs: 1087-1094). As used herein, the term "Trigger Sequences Group" refers to the group of sequences consisting of SEQ ID NOs:831, 842, 849, 898, 910, 925, 928, 931, 932, 937, 938, 940, 941, 942, 943, 944, 945, 947, 948, 949, 950, 951, 952, 955, 956, 957, 958, 960, 961, 964, 966, 967, 968, 969, 970, 971, 973, 976, 978, 979, 982, 983, 985, 987, 988, 989, 991, 992, 994, 995, 996, 997, 999, 1006, 1007, 1008, 1009, 1010, 1013, 1018, 1019, 1020, 1022, 1025, 1029, 1030, 1033, 1035, 1036, 1037, 1038, 1039, 1040, 1041, 1042, 1043, 1045, 1046, 1047, 1049, 1050, 1053, 1054, 1058, 1060, 1061, 1064, 1065, 1066, 1067, 1068, 1070, 1073, 1074, 1075, 1077, 1078, 1080, 1081, 1082, 1084, 1085, 1095, 1096, 1097, 1098, 1099, 1100, 1101, 1102, 1103, 1104, 1105, 1110, 1111, 1112, 1113, and 1114.

In various embodiments, the *Leptinotarsa* species is at least one selected from the group consisting of *Leptinotarsa behrensi*, *Leptinotarsa collinsi*, *Leptinotarsa decemlineata* (Colorado potato beetle), *Leptinotarsa defecta*, *Leptinotarsa haldemani* (Haldeman's green potato beetle), *Leptinotarsa heydeni*, *Leptinotarsa juncta* (false potato beetle), *Leptinotarsa lineolata* (burrobrush leaf beetle), *Leptinotarsa peninsularis*, *Leptinotarsa rubiginosa*, *Leptinotarsa texana*, *Leptinotarsa tlascalana*, *Leptinotarsa tumamoca*, and *Leptinotarsa typographica*. In specific embodiments, the *Leptinotarsa* species is at least one selected from the group consisting of *Leptinotarsa decemlineata* (Colorado potato beetle), *Leptinotarsa juncta* (false potato beetle), *Leptinotarsa haldemani* (Haldeman's green potato beetle), and *Leptinotarsa lineolata* (burrobrush leaf beetle).

Controlling *Leptinotarsa* Infestations by Contacting with a Polynucleotide

Provided herein are methods for controlling a *Leptinotarsa* species infestation of a plant by contacting the *Leptinotarsa* species with a polynucleotide comprising at least one segment of 18 or more contiguous nucleotides having about 95% to about 100% identity or complementarity with a corresponding fragment of a DNA or target gene selected from the group consisting of: the Target Gene Sequences Group, or the DNA complement thereof. In an embodiment, the method for controlling a *Leptinotarsa* species infestation of a plant comprises contacting the *Leptinotarsa* species with a polynucleotide comprising at least 21 contiguous nucleotides with 100% identity with a corresponding fragment of a target gene having a DNA sequence selected from the group consisting of: SEQ ID NO:730, SEQ ID NO:807, SEQ ID NOs:1-725, SEQ ID NOs:726-729, SEQ ID NOs: 731-806, SEQ ID NOs:808-830, and SEQ ID NOs:1087-1094, or the DNA complement thereof. In some embodiments, the polynucleotide is a double-stranded RNA. In some embodiments, the polynucleotide (e.g., double-stranded RNA) is chemically synthesized or is produced by expression in a microorganism or by expression in a plant cell. Embodiments include those in which the polynucleotide is a dsRNA comprising a sequence selected from the group consisting of SEQ ID NOs:831-1085, 1095-1104, and 1110-1114, or the complement thereof, or wherein the polynucleotide is encoded by a sequence selected from the group consisting of SEQ ID NOs:1105-1109. In an embodiment, the method for controlling a *Leptinotarsa* species infestation of a plant comprises contacting the *Leptinotarsa* species with a polynucleotide comprising a nucleotide sequence that is complementary to at least 21 contiguous nucleotides of a target gene encoded by a nucleotide sequence selected from the group consisting of: SEQ ID NO:730, SEQ ID NO:807, SEQ ID NOs:1-725, SEQ ID NOs:726-729, SEQ ID NOs: 731-806, SEQ ID NOs:808-830, and SEQ ID NOs:1087-1094, or an RNA transcribed from the target gene. Embodiments include those in which the polynucleotide is a dsRNA comprising a strand having a sequence selected from the Trigger Sequences Group. In some embodiments, the method uses a polynucleotide comprising one segment of 127 contiguous nucleotides (SEQ ID NO:831) which is the anti-sense (reverse complement) sequence of 127 contiguous nucleotides of the target gene encoded by SEQ ID NO:825. In some embodiments, the method uses a polynucleotide comprising segments of 409 and 403 contiguous nucleotides (SEQ ID NO:937 and SEQ ID NO:938, respectively) which are the anti-sense (reverse complement) sequences of 409 and 403 contiguous nucleotides, respectively, of a target gene encoded by SEQ ID NO:732. Polynucleotides of use in the method can be designed for multiple target genes. Related aspects of the invention include isolated polynucleotides of use in the method and plants having improved *Leptinotarsa* resistance provided by the method.

In some embodiments, the contiguous nucleotides have a sequence of about 95%, about 96%, about 97%, about 98%, about 99%, or about 100% identity with a fragment of equivalent length of a DNA or target gene having a sequence selected from the group consisting of: SEQ ID NOs:1-725 and SEQ ID NOs:726-830 and SEQ ID NOs:1087-1094 or the DNA complement thereof. In some embodiments, the contiguous nucleotides are exactly (100%) identical to a fragment of equivalent length of a DNA or target gene having a sequence selected from the Target Gene Sequences Group or the DNA complement thereof. In some embodiments, the polynucleotide has an overall sequence of about 95%, about 96%, about 97%, about 98%, about 99%, or about 100% identity with a fragment of equivalent length of a DNA or target gene having a sequence selected from the Target Gene Sequences Group or the DNA complement thereof. In an embodiment, the polynucleotide comprises at least one segment of 21 contiguous nucleotides with 100% identity with the corresponding fragment of a target gene having a DNA sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or the DNA complement thereof. In some embodiments, the polynucleotide comprises "neutral" sequence (sequence having no sequence identity or complementarity to the target gene) in addition to one or more segments of 21 contiguous nucleotides with 100% identity with the corresponding fragment of the target gene, and therefore the polynucleotide as a whole is of much lower overall sequence identity with a target gene.

Several embodiments relate to a polynucleotide designed to suppress one or more genes ("target genes"). The term "gene" refers to any portion of a nucleic acid that provides for expression of a transcript or encodes a transcript. A "gene" can include, but is not limited to, a promoter region, 5' untranslated regions, transcript encoding regions that can include intronic regions, 3' untranslated regions, or combinations of these regions. In some embodiments, the target genes can include coding or non-coding sequence or both. In other embodiments, the target gene has a sequence identical to or complementary to a messenger RNA, e.g., in some embodiments the target gene is a cDNA. In specific embodiments, the polynucleotide is designed to suppress one or more target genes, where each target gene is encoded by a DNA sequence selected from the Target Gene Sequences Group. In various embodiments, the polynucleotide is designed to suppress one or more target genes, where each target gene is encoded by a sequence selected from the Target Gene Sequences Group, and can be designed to suppress multiple target genes from this group, or to target different regions of one or more of these target genes. In an embodiment, the polynucleotide comprises multiple segments of 21 contiguous nucleotides with 100% identity with a fragment of equivalent length of a DNA or target gene having a sequence selected from the Target Gene Sequences Group or the DNA complement thereof. In such cases, each segment can be identical or different in size or in sequence, and can be sense or anti-sense relative to the target gene. For example, in one embodiment the polynucleotide comprises multiple segments in tandem or repetitive arrangements, wherein each segment comprises 21 contiguous nucleotides with a sequence of 100% identity with a fragment of equivalent length of a DNA or target gene having a sequence selected from the the Target Gene Sequences Group or the DNA complement thereof. In some embodiments, the segments can be from different regions of the target gene, e.g., the segments can correspond to different exon regions of the target gene. In some embodiments, "spacer" nucleotides which do not correspond to a target gene can optionally be used in between or adjacent to the segments.

The total length of the polynucleotide of use in this method can be greater than 18 contiguous nucleotides, and can include nucleotides in addition to the contiguous nucleotides having the sequence of about 95% to about 100% identity with a fragment of equivalent length of a DNA or target gene having a sequence selected from the group consisting of: the Target Gene Sequences Group or the DNA complement thereof. In other words, the total length of the polynucleotide can be greater than the length of the section or segment of the polynucleotide designed to suppress one or more target genes, where each target gene has a DNA sequence selected from the group consisting of the Target Gene Sequences Group. For example, the polynucleotide can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that are not specifically related (having a sequence not complementary or identical to) to the DNA or target gene having a sequence selected from the group consisting of: the Target Gene Sequences Group or the DNA complement thereof, e.g., nucleotides that provide stabilizing secondary structure or for convenience in cloning or manufacturing. In an embodiment, the polynucleotide can include additional nucleotides located immediately adjacent to one or more segment of 18 or more contiguous nucleotides with a sequence of about 95% to about 100% identity with a fragment of equivalent length of a DNA or target gene having a sequence selected from the group consisting of: the Target Gene Sequences Group or the DNA complement thereof. In an embodiment, the polynucleotide comprises one such segment, with an additional 5' G or an additional 3' C or both, adjacent to the segment. In another embodiment, the polynucleotide is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide is not 100% identical or complementary to a sequence of contiguous nucleotides in the DNA or target gene having a sequence selected from the group consisting of: the Target Gene Sequences Group, or the DNA complement thereof. For example, in some embodiments the polynucleotide comprises at least two segments each of 21 contiguous nucleotides with a sequence of 100% identity with a fragment of a DNA having a sequence selected from the group consisting of: the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the group consisting of: the Target Gene Sequences Group, or the DNA complement thereof.

The polynucleotide of use in this method is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In some embodiments the polynucleotide of use in this method is provided as an isolated DNA or RNA fragment. In some embodiments the polynucleotide of use in this method is not part of an expression construct and is lacking additional elements such as a promoter or terminator sequences). Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Embodiments include those in which the polynucleotide is a dsRNA comprising a segment having a sequence selected from the group consisting of: SEQ ID NOs:831-1085, 1095-1104, and 1110-1114, or the complement thereof, or wherein the polynucleotide is encoded by a sequence selected from the group consisting of SEQ ID NOs:1105-1109. Alternatively the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., an insecticidal protein).

In various embodiments of the method, the contacting comprises application to a surface of the *Leptinotarsa* species of a suitable composition comprising the polynucleotide of use in this method; such a composition can be provided, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. The contacting can be in the form of a seed treatment, or in the form of treatment of "seed potato" tubers or pieces of tuber (e.g., by soaking, coating, or dusting the seed potato). Suitable binders, inert carriers, surfactants, and the like can optionally be included in the composition, as is known to one skilled in formulation of pesticides and seed treatments. In some embodiments, the contacting comprises providing the polynucleotide in a composition that further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In some embodiments, the contacting comprises providing the polynucleotide in a composition that further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. In one embodiment the contacting comprises providing the polynucleotide in a composition that can be ingested or otherwise absorbed internally by the *Leptinotarsa* species.

It is anticipated that the combination of certain polynucleotides of use in this method (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, a composition containing one or more polynucleotides and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to effect synergistically improved prevention or control of *Leptinotarsa* species infestations.

Controlling *Leptinotarsa* Infestations by Providing a Dietary Polynucleotide

Another aspect of this invention provides a method for controlling a *Leptinotarsa* species infestation of a plant comprising providing in the diet of a *Leptinotarsa* species an agent comprising a polynucleotide having at least one segment of 18 or more contiguous nucleotides with a sequence of about 95% to about 100% identity with a fragment of equivalent length of a DNA having a sequence selected from the group consisting of: The Target Gene Sequences Group or the DNA complement thereof, wherein the agent functions upon ingestion by the *Leptinotarsa* species to inhibit a biological function within the *Leptinotarsa* species thereby controlling infestation by the *Leptinotarsa* species. The polynucleotide can be longer than the segment or segments it contains, but each polynucleotide segment and corresponding DNA fragment are of equivalent length. Polynucleotides of use in the method can be designed for multiple target genes. Embodiments include those in which the agent comprises a dsRNA comprising a segment having a sequence selected from the group consisting of: SEQ ID NOs:831-1085, 1095-1104, and 1110-1114, or the complement thereof, or wherein the agent comprises a polynucleotide or RNA encoded by a sequence selected from the group consisting of SEQ ID NOs:1105-1109. In an embodiment, a method for controlling a *Leptinotarsa* species infestation of a plant comprising providing in the diet of the *Leptinotarsa* species a polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene is provided. In some embodiments, the polynucleotide is a double-stranded RNA. In some embodiments, the polynucleotide (e.g., double-stranded RNA) is chemically synthesized or is produced by expression in a microorganism or by expression in a plant cell. Embodiments include those in which the polynucleotide is a dsRNA with a strand having a sequence selected from the group consisting of the Trigger Sequences Group. Related aspects of the invention include isolated polynucleotides of use in the method and plants having improved *Leptinotarsa* resistance provided by the method.

In various embodiments, the agent comprising a polynucleotide comprises a microbial cell or is produced in a microorganism. For example, the agent can include or can be produced in bacteria or yeast cells. In other embodiments the agent comprising a polynucleotide comprises a transgenic plant cell or is produced in a plant cell (for example a plant cell transiently expressing the polynucleotide); such plant cells can be cells in an plant or cells grown in tissue culture or in cell suspension.

In various embodiments, the agent comprising a polynucleotide is provided for dietary uptake by the *Leptinotarsa* species in a form suitable for ingestion, for example, as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. The agent comprising a polynucleotide can be provided for dietary uptake by the *Leptinotarsa* species by applying the agent to a plant subject to infestation by the *Leptinotarsa* species or by applying the agent to seed of the plant, for example by spraying, dusting, or coating the plant, or by application of a soil drench, or by providing in an artificial diet. The agent comprising a polynucleotide can be provided for dietary uptake by the *Leptinotarsa* species in an artificial diet formulated to meet the particular nutritional requirements for maintaining the *Leptinotarsa* species, wherein the artificial diet is supplemented with some amount of the polynucleotide obtained from a separate source such as chemical synthesis or purified from a microbial fermentation; this embodiment can be useful, e.g., for determining the timing and amounts of effective polynucleotide treatment regimes. In some embodiments the agent comprising a polynucleotide is provided for dietary uptake by the *Leptinotarsa* species in the form of a plant cell or in plant cell components, or in a microorganism (such as a bacterium or a yeast) or a microbial fermentation product, or in a synthetic or man-made diet. In one embodiment the agent comprising a polynucleotide is provided in the form of bait that is ingested by the *Leptinotarsa* species. The agent comprising a polynucleotide can be provided for dietary uptake by the *Leptinotarsa* species in the form of a seed treatment, or in the form of treatment of "seed potato" tubers or pieces of tuber (e.g., by soaking, coating, or dusting the seed potato). Suitable binders, inert carriers, surfactants, and the like can be included in the agent, as is known to one skilled in formulation of pesticides and seed treatments. In some embodiments, the agent comprising a polynucleotide further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In some embodiments, the agent comprising a polynucleotide further comprises at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporus* insecticidal protein, and a *Bacillus sphaericus* insecticidal protein. In some embodiments, the agent comprising a polynucleotide comprises at least one implantable formulation selected from the group consisting of a particulate, pellet, or capsule implanted in the plant; in such embodiments the method comprises implanting in the plant the implantable formulation. In some embodiments, the agent comprising a polynucleotide comprises at least one in-furrow formulation selected from the group consisting of a powder, granule, pellet, capsule, spray, or drench, or any other forms suited for applying to a furrow; in such embodiments, the method comprises an in-furrow treatment with the in-furrow formulation. In some embodiments, the method comprises treatment of a solanaceous plant seed, potato tuber, or piece of potato tuber with the agent.

It is anticipated that the combination of certain polynucleotides of use in agents of use in this method (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, a composition containing one or more polynucleotides and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporus* insecticidal protein, and a *Bacillus sphaericus* insecticidal protein, is found to effect synergistically improved prevention or control of *Leptinotarsa* species infestations when provided to the *Leptinotarsa* species in a diet.

In some embodiments, the polynucleotide is a dsRNA comprising a segment having a sequence selected from the group consisting of: SEQ ID NOs:831-1085, 1095-1104, and 1110-1114, or the complement thereof, or wherein the polynucleotide is encoded by a sequence selected from the group consisting of SEQ ID NOs:1105-1109.

In some embodiments, the contiguous nucleotides have a sequence of about 95%, about 96%, about 97%, about 98%, about 99%, or about 100% identity with a fragment of equivalent length of a DNA or target gene having a sequence selected from The Target Gene Sequences Group or the DNA complement thereof. In some embodiments the contiguous nucleotides are exactly (100%) identical to a fragment of equivalent length of a DNA or target gene having a sequence selected from The Target Gene Sequences Group or the DNA complement thereof. In some embodiments, the polynucleotide has an overall sequence of about 95%, about 96%, about 97%, about 98%, about 99%, or about 100% identity with a fragment of equivalent length of a DNA or target gene having a sequence selected from The Target Gene Sequences Group or the DNA complement thereof. In an embodiment, the polynucleotide comprises at least one segment of 21 contiguous nucleotides with a sequence of 100% identity with the corresponding fragment of a target gene having a DNA sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or the DNA complement thereof; in some embodiments, the polynucleotide comprises "neutral" sequence (having no sequence identity or complementarity to the target gene) in addition to a segment of 21 contiguous nucleotides with 100% identity with the corresponding fragment of the target gene, and therefore the polynucleotide as a whole is of much lower overall sequence identity with a target gene.

The polynucleotide of use in this method is generally designed to suppress one or more genes ("target genes"). The term "gene" refers to any portion of a nucleic acid that provides for expression of a transcript or encodes a transcript. A "gene" can include, but is not limited to, a promoter region, 5' untranslated regions, transcript encoding regions that can include intronic regions, 3' untranslated regions, or combinations of these regions. In some embodiments, the target genes can include coding or non-coding sequence or both. In other embodiments, the target gene has a sequence identical to or complementary to a messenger RNA, e.g., in some embodiments the target gene is a cDNA. In specific embodiments, the polynucleotide is designed to suppress one or more target genes, where each target gene has a DNA sequence selected from the group consisting of the Target Gene Sequences Group. In various embodiments, the polynucleotide is designed to suppress one or more target genes, where each target gene has a sequence selected from the group consisting of the Target Gene Sequences Group, and can be designed to suppress multiple target genes from this group, or to target different regions of one or more of these target genes. In an embodiment, the polynucleotide comprises multiple segments of 21 contiguous nucleotides with a sequence of 100% identity with a fragment of equivalent length of a DNA or target gene having a sequence selected from The Target Gene Sequences Group or the DNA complement thereof. In such cases, each segment can be identical or different in size or in sequence, and can be sense or anti-sense relative to the target gene. For example, in one embodiment the polynucleotide comprises multiple segments in tandem or repetitive arrangements, wherein each segment comprises 21 contiguous nucleotides with a sequence of 100% identity with a fragment of equivalent length of a DNA or target gene having a sequence selected from The Target Gene Sequences Group or the DNA complement thereof; the segments can be from different regions of the target gene, e.g., the segments can correspond to different exon regions of the target gene, and "spacer" nucleotides which do not correspond to a target gene can optionally be used in between or adjacent to the segments.

The total length of the polynucleotide of use in this method can be greater than 18 contiguous nucleotides, and can include nucleotides in addition to the contiguous nucleotides having the sequence of about 95% to about 100% identity with a fragment of equivalent length of a DNA or target gene having a sequence selected from The Target Gene Sequences Group or the DNA complement thereof. In other words, the total length of the polynucleotide can be greater than the length of the section or segment of the polynucleotide designed to suppress one or more target genes, where each target gene has a DNA sequence selected from the group consisting of the Target Gene Sequences Group. For example, the polynucleotide can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that are not specifically related (having a sequence not complementary or identical to) to the DNA or target gene having a sequence selected from The Target Gene Sequences Group or the DNA complement thereof, e.g., nucleotides that provide stabilizing secondary structure or for convenience in cloning or manufacturing. In an embodiment, the polynucleotide can include additional nucleotides located immediately adjacent to one or more segment of 18 or more contiguous nucleotides with a sequence of about 95% to about 100% identity with a fragment of equivalent length of a DNA or target gene having a sequence selected from The Target Gene Sequences Group or the DNA complement thereof. In an embodiment, the polynucleotide comprises one such segment, with an additional 5' G or an additional 3' C or both, adjacent to the segment. In another embodiment, the polynucleotide is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide is not 100% identical or complementary to a sequence of contiguous nucleotides in the DNA or target gene having a sequence selected from The Target Gene Sequences Group, or the DNA complement thereof. For example, in some embodiments the polynucleotide comprises at least two segments of 21 contiguous nucleotides with a sequence of 100% identity with a fragment of a DNA having a sequence selected from The Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from The Target Gene Sequences Group, or the DNA complement thereof.

The polynucleotide of use in this method is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In some embodiments the polynucleotide of use in this method is provided as an isolated DNA or RNA fragment. In some embodiments the polynucleotide of use in this method is not part of an expression construct and is lacking additional elements such as a promoter or terminator sequences. Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Alternatively the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., an insecticidal protein).

Controlling *Leptinotarsa* Infestations by Providing a Dietary RNA

Another aspect of this invention provides a method of causing mortality or stunting in larvae of the *Leptinotarsa* species by providing in the diet of the larvae at least one polynucleotide comprising at least one silencing element comprising 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In some embodiments, the polynucleotide is a double-stranded RNA. In some embodiments, the polynucleotide (e.g., double-stranded RNA) is chemically synthesized or is produced by expression in a microorganism or by expression in a plant cell. In an embodiment, a method of causing mortality or stunting in *Leptinotarsa* species larvae comprising providing in the diet of *Leptinotarsa* species larvae at least one RNA comprising at least one silencing element essentially identical or essentially complementary to a fragment of a target gene sequence of the *Leptinotarsa* species larvae, wherein the target gene sequence is selected from the group consisting of the Target Gene Sequences Group, and wherein ingestion of the RNA by the *Leptinotarsa* species larvae results in mortality or stunting in the *Leptinotarsa* species larvae is provided. A related aspect of this invention is an RNA comprising at least one silencing element, wherein the at least one silencing element is essentially identical or essentially complementary to a fragment of a target gene of the *Leptinotarsa* species larvae, wherein the target gene sequence is selected from the group consisting of the Target Gene Sequences Group. The RNA can be longer than the silencing element or silencing elements it contains, but each silencing element and corresponding fragment of a target gene sequence are of equivalent length. RNAs of use in the method can be designed for multiple target genes; embodiments include RNAs comprising at least one silencing element comprising a sequence selected from the group consisting of: SEQ ID NOs:831-1085, 1095-1104, and 1110-1114, or the complement thereof, or wherein the silencing element is encoded by a sequence selected from the group consisting of SEQ ID NOs:1105-1109. Embodiments include those in which the RNA comprises a dsRNA with a strand having a sequence selected from the group consisting of the Trigger Sequences Group. In a related aspect, a method of causing mortality or lower fecundity in *Leptinotarsa* species comprising providing in the diet of *Leptinotarsa* species at least one RNA comprising at least one silencing element essentially identical or essentially complementary to a fragment of a target gene sequence of the *Leptinotarsa* species larvae, wherein the target gene sequence is selected from The Target Gene Sequences Group, or the DNA complement thereof, and wherein ingestion of the RNA by the *Leptinotarsa* species results in mortality or lower fecundity in the *Leptinotarsa* species is provided. Related aspects of the invention include isolated RNAs of use in the method and plants having improved *Leptinotarsa* resistance provided by the method.

In various embodiments, the diet providing the RNA comprises a microbial cell or is produced in a microorganism. For example, the diet providing the RNA can include or can be produced in bacteria or yeast cells. In similar embodiments the diet providing the RNA comprises a transgenic plant cell or is produced in a plant cell (for example a plant cell transiently expressing the polynucleotide); such plant cells can be cells in an plant or cells grown in tissue culture or in cell suspension.

In one embodiment the diet providing the RNA is provided in the form of any plant that is subject to infestation by a *Leptinotarsa* species, wherein the RNA is contained in or on the plant. Such plants can be stably transgenic plants that express the RNA, or non-transgenic plants that transiently express the RNA or that have been treated with the RNA, e.g., by spraying or coating. Stably transgenic plants generally contain integrated into their genome a recombinant construct that encodes the RNA. Of particular interest are embodiments wherein the plant is a solanaceous plant (family Solanaceae). Examples include a plant selected from the group consisting of potato, tomato, and eggplant. Embodiments include those wherein the plant is an ungerminated solanaceous plant seed, a solanaceous plant in a vegetative stage, or a solanaceous plant in a reproductive stage. Embodiments include those wherein the plant is a "seed potato", meaning a potato tuber or piece of potato tuber which can be propagated into new potato plants.

In various embodiments, the diet providing the RNA is provided in a form suitable for ingestion by the *Leptinotarsa* species, for example, as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. The diet providing the RNA can be provided by applying the diet to a plant subject to infestation by the *Leptinotarsa* species, for example by spraying, dusting, or coating the plant, or by application of a soil drench, or by providing in an artificial diet. In one embodiment the diet providing the recombinant RNA is provided in the form of bait that is ingested by the *Leptinotarsa* species. The diet providing the RNA can be an artificial diet formulated to meet the particular nutritional requirements for maintaining the *Leptinotarsa* species, wherein the artificial diet is supplemented with some amount of the RNA obtained from a separate source such as chemical synthesis or purified from a microbial fermentation; this embodiment can be useful, e.g., for determining the timing and amounts of effective polynucleotide treatment regimes. In some embodiments the diet providing the RNA is provided in the form of a plant cell or in plant cell components, or in a microorganism (such as a bacterium or a yeast) or a microbial fermentation product, or in a synthetic diet. In one embodiment the diet providing the RNA is provided in the form of bait that is ingested by the *Leptinotarsa* species. The diet providing the RNA can be provided in the form of a seed treatment, or in the form of treatment of "seed potato" tubers or pieces of tuber (e.g., by soaking, coating, or dusting the seed potato). Suitable binders, inert carriers, surfactants, and the like can be included in the diet, as is known to one skilled in formulation of pesticides and seed treatments. In some embodiments, the diet providing the RNA further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In some embodiments, the diet providing the RNA further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. In some embodiments, the diet providing the RNA includes at least one implantable formulation selected from the group consisting of a particulate, pellet, or capsule implanted in the plant; in such embodiments the method comprises implanting in the plant the implantable formulation. In some embodiments, the diet providing the RNA includes at least one in-furrow formulation selected from the group consisting of a powder, granule, pellet, capsule, spray, or drench, or any other forms suited for applying to a furrow; in such embodiments, the method includes an in-furrow treatment with the in-furrow formulation. In some embodiments, the method comprises treatment of a solanaceous plant seed, potato tuber, or piece of potato tuber with the agent.

It is anticipated that the combination of certain RNAs of use in this method (e.g., the dsRNA triggers described in the working Examples) with one or more non-polynucleotide pesticidal agents will result in a synergetic improvement in prevention or control of *Leptinotarsa* species infestations, when compared to the effect obtained with the RNA alone or the non-polynucleotide pesticidal agent alone. In an embodiment, a composition containing one or more RNAs and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to effect synergistically improved prevention or control of *Leptinotarsa* species infestations.

The RNA of use in this method can be single-stranded (ss) or double-stranded (ds). Embodiments of the method include those wherein the RNA is at least one selected from the group consisting of sense single-stranded RNA (ssRNA), anti-sense single-stranded (ssRNA), or double-stranded RNA (dsRNA); a mixture of RNAs of any of these types can be used. In one embodiment a double-stranded DNA/RNA hybrid is used. The RNA can include components other than standard ribonucleotides, e.g., an embodiment is an RNA that comprises terminal deoxyribonucleotides.

The RNA comprises at least one silencing element, wherein the silencing element is essentially identical (as the RNA equivalent) or essentially complementary to a fragment of a target gene of the *Leptinotarsa* species larvae, wherein the target gene sequence is selected from the group consisting of the Target Gene Sequences Group. In some embodiments, the silencing element has a sequence of about 95%, about 96%, about 97%, about 98%, about 99%, or about 100% identity with or complementarity to a fragment of equivalent length of a DNA having a sequence selected from the group consisting of the Target Gene Sequences Group. In some embodiments the silencing element is exactly (100%) identical or exactly (100%) complementary (as the RNA equivalent) to a fragment of equivalent length of a DNA having a sequence selected from The Target Gene Sequences Group or the DNA complement thereof. In some embodiments, the RNA containing the silencing element(s) has an overall sequence of about 95%, about 96%, about 97%, about 98%, about 99%, or about 100% identity with or complementarity to the fragment of a DNA having a sequence selected from the group consisting of the Target Gene Sequences Group.

In some embodiments, the silencing element comprises at least one segment of 18 or more contiguous nucleotides with a sequence of about 95% to about 100% identity with or complementarity to a fragment of equivalent length of the target gene. In some embodiments the silencing element comprises at least one segment of 18 or more contiguous nucleotides with a sequence of about 95% to about 100% identity with or complementarity to a fragment of equivalent length of a DNA having a sequence selected from the group consisting of the Target Gene Sequences Group. In some embodiments the silencing element comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the silencing element comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the silencing element comprises at least one segment of at least 21 contiguous nucleotides with a sequence of 100% identity with a fragment of equivalent length of a DNA or target gene having a sequence selected from The Target Gene Sequences Group or the DNA complement thereof. In particular embodiments, the RNA is a double-stranded nucleic acid (e.g., dsRNA) with one strand comprising at least one segment of at least 21 contiguous nucleotides with a sequence of 100% identity with a fragment of equivalent length of a DNA or target gene having a sequence selected from The Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from The Target Gene Sequences Group or the DNA complement thereof. In particular embodiments, each silencing element contained in the RNA is of a length greater than that which is typical of naturally occurring regulatory small RNAs, e.g., each segment is at least about 30 contiguous nucleotides (or base-pairs) in length. In some embodiments, the total length of the RNA, or the length of each silencing element contained in the RNA, is less than the total length of the sequence of interest (DNA or target gene having a sequence selected from the group consisting of the Target Gene Sequences Group). In some embodiments, the total length of the RNA is between about 50 to about 500 nucleotides (for single-stranded polynucleotides) or base-pairs (for double-stranded polynucleotides). In some embodiments, the RNA is a dsRNA of between about 100 to about 500 base-pairs, such as a dsRNA of the length of any of the dsRNA triggers disclosed in Tables 3, 5, 8, 9, and 10. Embodiments include those in which the RNA is a dsRNA comprising a segment having a sequence selected from the group consisting of: SEQ ID NOs:831-1085, 1095-1104, and 1110-1114, or the complement thereof, or wherein the RNA is encoded by a sequence selected from the group consisting of SEQ ID NOs:1105-1109.

The RNA of use in this method is generally designed to suppress one or more genes ("target genes"). The term "gene" refers to any portion of a nucleic acid that provides for expression of a transcript or encodes a transcript. A "gene" can include, but is not limited to, a promoter region, 5' untranslated regions, transcript encoding regions that can include intronic regions, 3' untranslated regions, or combinations of these regions. In some embodiments, the target genes can include coding or non-coding sequence or both. In other embodiments, the target gene has a sequence identical to or complementary to a messenger RNA, e.g., in some embodiments the target gene is a cDNA. In specific embodiments, the RNA is designed to suppress one or more target genes, where each target gene has a DNA sequence selected from the group consisting of the Target Gene Sequences Group. In various embodiments, the RNA is designed to suppress one or more genes, where each gene has a sequence selected from the group consisting of the Target Gene Sequences Group, and can be designed to suppress multiple genes from this group, or to target different regions of one or more of these genes. In an embodiment, the RNA comprises multiple silencing elements each of which comprises at least one segment of 21 contiguous nucleotides with a sequence of 100% identity with or 100% complementarity to a fragment of equivalent length of a DNA having a sequence selected from The Target Gene Sequences Group or the DNA complement thereof. In such cases, each silencing element can be identical or different in size or in sequence, and can be sense or anti-sense relative to the target gene. For example, in one embodiment the RNA can include multiple silencing elements in tandem or repetitive arrangements, wherein each silencing element comprises at least one segment of 21 contiguous nucleotides with a sequence of 100% identity with or 100% complementarity to a fragment of equivalent length of a DNA having a sequence selected from the group consisting of the Target Gene Sequences Group; the segments can be from different regions of the target gene, e.g., the segments can correspond to different exon regions of the target gene, and "spacer" nucleotides which do not correspond to a target gene can optionally be used in between or adjacent to the segments.

The total length of the RNA can be greater than 18 contiguous nucleotides, and can include nucleotides in addition to the silencing element having a sequence of about 95% to about 100% identity with or complementarity to a fragment of equivalent length of a DNA or target gene having a sequence selected from the group consisting of the Target Gene Sequences Group. In other words, the total length of the RNA can be greater than the length of the silencing element designed to suppress one or more target genes, where each target gene has a DNA sequence selected from the group consisting of the Target Gene Sequences Group. For example, the RNA can have nucleotides flanking the "active" silencing element of at least one segment of 18 or more contiguous nucleotides that suppresses the target gene, or include "spacer" nucleotides between active silencing elements, or can have additional nucleotides at the 5' end, or at the 3' end, or at both the 5' and 3' ends. In an embodiment, the RNA comprises additional nucleotides that are not specifically related (ihaving a sequence not complementary or identical to) to the DNA or target gene having a sequence selected from The Target Gene Sequences Group or the DNA complement thereof, e.g., nucleotides that provide stabilizing secondary structure or for convenience in cloning or manufacturing. In an embodiment, the RNA comprises additional nucleotides located immediately adjacent to one or more silencing element of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the RNA comprises one such silencing element, with an additional 5' G or an additional 3' C or both, adjacent to the silencing element. In another embodiment, the RNA is a double-stranded RNA comprising additional nucleotides to form an overhang, for example, a dsRNA comprising 2 deoxyribonucleotides to form a 3' overhang. Thus in various embodiments, the nucleotide sequence of the entire RNA is not 100% identical or complementary to a fragment of contiguous nucleotides in the DNA or target gene having a sequence selected from the group consisting of the Target Gene Sequences Group. For example, in some embodiments the RNA comprises at least two silencing elements each of 21 contiguous nucleotides with a sequence of 100% identity with a fragment of a DNA having a sequence selected from the group consisting of the Target Gene Sequences Group4, or the DNA complement thereof, wherein (1) the at least two silencing elements are separated by one or more spacer nucleotides, or (2) the at least two silencing elements are arranged in an order different from that in which the corresponding fragments occur in the DNA having a sequence selected from the group consisting of the Target Gene Sequences Group, or the DNA complement thereof.

In some embodiments the RNA consists of naturally occurring ribonucleotides. In certain embodiments, the RNA comprises components other than ribonucleotides, for example, synthetic RNAs consisting mainly of ribonucleotides but with one or more terminal deoxyribonucleotides or one or more terminal dideoxyribonucleotides. In certain embodiments, the RNA comprises non-canonical nucleotides such as inosine, thiouridine, or pseudouridine. In certain embodiments, the RNA comprises chemically modified nucleotides.

The RNA of use in this method is provided by suitable means known to one in the art. Embodiments include those wherein the RNA is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In some embodiments the RNA is provided as an isolated RNA that is not part of an expression construct and is lacking additional elements such as a promoter or terminator sequences. Such RNAs can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively the RNA can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as including additional RNA encoding an aptamer or ribozyme or an expression cassette for expressing a gene of interest (e.g., an insecticidal protein).

Methods of Providing Plants Having Improved Resistance to *Leptinotarsa* Infestations, and the Plants, Plant Parts, and Seeds Thus Provided Another aspect of this invention provides a method of providing a plant having improved resistance to a *Leptinotarsa* species infestation comprising topically applying to the plant a composition comprising at least one polynucleotide having at least one segment of 18 or more contiguous nucleotides with a sequence of about 95% to about 100% identity with a fragment of a target gene or DNA having a sequence selected from The Target Gene Sequences Group, or the DNA complement thereof, in a manner such that the plant treated with the polynucleotide-containing composition exhibits improved resistance to a *Leptinotarsa* species infestation, relative to an untreated plant. In an embodiment, the at least one polynucleotide comprises at least one segment of 18 or more contiguous nucleotides that are essentially identical to a fragment of equivalent length of a DNA having a sequence selected from the Target Gene Sequences Group, or the DNA complement thereof. The polynucleotide can be longer than the segment or segments it contains, but each segment and corresponding fragment of a target gene are of equivalent length. In an embodiment, this invention provides a method of providing a plant having improved resistance to a *Leptinotarsa* species infestation comprising topically applying to the plant a composition comprising at least one polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene. In an embodiment, this invention provides a method of providing a plant having improved resistance to a *Leptinotarsa* species infestation comprising topically applying to the plant a composition comprising at least one polynucleotide in a manner such that an effective amount of the polynucleotide is ingested by *Leptinotarsa* species feeding on the plant, the polynucleotide comprising at least 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs: 731-806, SEQ ID NOs:808-830, and SEQ ID NOs:1087-1094, or an RNA transcribed from the target gene. In some embodiments, this invention provides a method for controlling a *Leptinotarsa* species infestation of a plant comprising topically applying to the plant a composition comprising at least one polynucleotide in a manner such that an effective amount of the polynucleotide is ingested by *Leptinotarsa* species feeding on the plant, the polynucleotide comprising a nucleotide sequence that is complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene; wherein the *Leptinotarsa* species is *Leptinotarsa decemlineata*; and wherein the target gene has the sequence of SEQ ID NO:730 or wherein the polynucleotide is a double-stranded RNA having a strand with a sequence selected from the group consisting of SEQ ID NO:989, 988, 1104, or 1105. Polynucleotides of use in the method can be designed for multiple target genes. Embodiments include those in which the polynucleotide comprises a segment having a sequence selected from the group consisting of: SEQ ID NOs:831-1085, 1095-1104, and 1110-1114, or the complement thereof, or wherein the polynucleotide is encoded by a sequence selected from the group consisting of SEQ ID NOs:1105-1109. Embodiments include those in which the composition comprises a dsRNA with a strand having a sequence selected from the group consisting of the Trigger Sequences Group. Related aspects of the invention include compositions for topical application and isolated polynucleotides of use in the method, and plants having improved *Leptinotarsa* resistance provided by the method.

By "topical application" is meant application to the surface or exterior of an object, such as the surface or exterior of a plant, such as application to the surfaces of a plant part such as a leaf, stem, flower, fruit, shoot, root, seed, tuber, flowers, anthers, or pollen, or application to an entire plant, or to the above-ground or below-ground portions of a plant. Topical application can be carried out on non-living surfaces, such as application to soil, or to a surface or matrix by which a *Leptinotarsa* insect can come in contact with the polynucleotide. In various embodiments of the method, the composition comprising at least one polynucleotide is topically applied to the plant in a suitable form, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. In some embodiments of the method, the polynucleotide-containing composition is topically applied to above-ground parts of the plant, e.g., sprayed or dusted onto leaves, stems, and flowering parts of the plant. Embodiments of the method include topical application of a foliar spray (e.g., spraying a liquid polynucleotide-containing composition on leaves of a solanaceous plant) or a foliar dust (e.g., dusting a solanaceous plant with a polynucleotide-containing composition in the form of a powder or on carrier particulates). In other embodiments, the polynucleotide-containing composition is topically applied to below-ground parts of the plant, such as to the roots, e.g., by means of a soil drench. In other embodiments, the polynucleotide-containing composition is topically applied to a seed that is grown into the plant. The topical application can be in the form of topical treatment of fruits of solanaceous plants or seeds from fruits of solanaceous plants, or in the form of topical treatment of "seed potato" tubers or pieces of tuber (e.g., by soaking, coating, or dusting the seed potato). Suitable binders, inert carriers, surfactants, and the like can optionally be included in the polynucleotide-containing composition, as is known to one skilled in formulation of pesticides and seed treatments. In some embodiments, the polynucleotide-containing composition is at least one topically implantable formulation selected from the group consisting of a particulate, pellet, or capsule topically implanted in the plant; in such embodiments the method comprises topically implanting in the plant the topically implantable formulation. In some embodiments, the polynucleotide-containing composition is at least one in-furrow formulation selected from the group consisting of a powder, granule, pellet, capsule, spray, or drench, or any other forms suited for topically applying to a furrow; in such embodiments, the method includes an in-furrow treatment with the in-furrow formulation. In one embodiment the polynucleotide-containing composition can be ingested or otherwise absorbed internally by the *Leptinotarsa* species. For example, the polynucleotide-containing composition can be in the form of bait. In some embodiments, the polynucleotide-containing composition further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In one embodiment the composition further comprises a nonionic organosilicone surfactant such as SIL-WET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. In some embodiments, the topically applied composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Alternatively such additional components or pesticidal agents can be provided separately, e.g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants, e.g., SIL-WET L-77® brand surfactant, followed by a second topical application of the polynucleotide-containing composition, or vice-versa.

It is anticipated that the combination of certain polynucleotides useful in the polynucleotide-containing composition (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, the polynucleotide-containing composition is provided as a transgenic plant expressing one or more polynucleotides and one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, wherein the transgenic plant is found to exhibit synergistically improved resistance to *Leptinotarsa* species infestations.

The polynucleotide useful in the polynucleotide-containing composition is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide useful in the polynucleotide-containing composition is provided as an isolated DNA or RNA fragment. In some embodiments the polynucleotide useful in the polynucleotide-containing composition is not part of an expression construct and is lacking additional elements such as a promoter or terminator sequences). Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Alternatively the polynucleotide can be provided in more complex constructs, e.g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e.g., an insecticidal protein).

The polynucleotide useful in the polynucleotide-containing composition has at least one segment of 18 or more contiguous nucleotides with a sequence of about 95% to about 100% identity with a fragment of equivalent length of a DNA having a sequence selected from the Target Gene Sequences Group or the DNA complement thereof. In an embodiment the polynucleotide comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the group consisting of: SEQ ID NOs:1-725 or SEQ ID NOs:726-830 or SEQ ID NOs:1087-1094 or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the polynucleotide has an overall sequence of about 95%, about 96%, about 97%, about 98%, about 99%, or about 100% identity with a fragment of a DNA having a sequence selected from the Target Gene Sequences Group or the DNA complement thereof.

The polynucleotide useful in the polynucleotide-containing composition comprises at least one segment of 18 or more contiguous nucleotides with a sequence of about 95% to about 100% identity with a fragment of equivalent length of a DNA having a sequence selected from the Target Gene Sequences Group or the DNA complement thereof. In some embodiments the polynucleotide comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the polynucleotide comprises at least one segment of at least 21 contiguous nucleotides with a sequence of 100% identity with a fragment of equivalent length of a DNA or target gene having a sequence selected from the Target Gene Sequences Group or the DNA complement thereof. In particular embodiments, the polynucleotide is a double-stranded nucleic acid (e.g., dsRNA) with one strand comprising at least one segment of at least 21 contiguous nucleotides with a sequence of 100% identity with a fragment of equivalent length of a DNA or target gene having a sequence selected from the Target Gene Sequences Group or the DNA complement thereof expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In particular embodiments, each segment contained in the polynucleotide is of a length greater than that which is typical of naturally occurring regulatory small RNAs, e.g., each segment is at least about 30 contiguous nucleotides (or base-pairs) in length. In some embodiments, the total length of the polynucleotide, or the length of each segment contained in the polynucleotide, is less than the total length of the sequence of interest (DNA or target gene having a sequence selected from the group consisting of the Target Gene Sequences Group). In some embodiments, the total length of the polynucleotide is between about 50 to about 500 nucleotides (for single-stranded polynucleotides) or base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. In some embodiments, the polynucleotide is a dsRNA comprising a segment having a sequence selected from the group consisting of: SEQ ID NOs:831-1085, 1095-1104, and 1110-1114, or the complement thereof, or the polynucleotide is encoded by a sequence selected from the group consisting of SEQ ID NOs:1105-1109.

The topically applied polynucleotide is generally designed to suppress one or more genes ("target genes"). Such target genes can include coding or non-coding sequence or both. In specific embodiments, the polynucleotide is designed to suppress one or more target genes, where each target gene has a DNA sequence selected from the group consisting of the Target Gene Sequences Group. In various embodiments, the topically applied polynucleotide is designed to suppress one or more genes, where each gene has a sequence selected from the group consisting of the Target Gene Sequences Group, and can be designed to suppress multiple genes from this group, or to target different regions of one or more of these genes. In an embodiment, the topically applied polynucleotide comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence, and can be sense or anti-sense relative to the target gene. For example, in one embodiment the topically applied polynucleotide can include multiple sections in tandem or repetitive arrangements, wherein each section comprises at least one segment of 21 contiguous nucleotides with a sequence of 100% identity with a fragment of equivalent length of a DNA having a sequence selected from the group consisting of: SEQ ID NOs:1-725 or SEQ ID NOs:726-830 or SEQ ID NOs:1087-1094 or the DNA complement thereof the segments can be from different regions of the target gene, e.g., the segments can correspond to different exon regions of the target gene, and "spacer" nucleotides which do not correspond to a target gene can optionally be used in between or adjacent to the segments.

The total length of the topically applied polynucleotide can be greater than 18 contiguous nucleotides, and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the topically applied polynucleotide can be greater than the length of the section or segment of the polynucleotide designed to suppress one or more target genes, where each target gene has a DNA sequence selected from the group consisting of the Target Gene Sequences Group. For example, the topically applied polynucleotide can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the topically applied polynucleotide comprises additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the topically applied polynucleotide comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the topically applied polynucleotide comprises one such segment, with an additional 5' G or an additional 3' C or both, adjacent to the segment. In another embodiment, the topically applied polynucleotide is a double-stranded RNA comprising additional nucleotides to form an overhang, for example, a dsRNA comprising 2 deoxyribonucleotides to form a 3' overhang. Thus in various embodiments, the nucleotide sequence of the entire topically applied polynucleotide is not 100% identical or complementary to a fragment of contiguous nucleotides in the DNA or target gene having a sequence selected from the group consisting of the Target Gene Sequences Group. For example, in some embodiments the topically applied polynucleotide comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In a related aspect, this invention is directed to the plant having improved resistance to a *Leptinotarsa* species infestation, provided by this method which comprises topically applying to the plant a composition comprising at least one polynucleotide having at least one segment of 18 or more contiguous nucleotides with a sequence of about 95% to about 100% identity with a fragment of equivalent length of a DNA having a sequence selected from the Target Gene Sequences Group or the DNA complement thereof, whereby the plant treated with the polynucleotide composition exhibits improved resistance to a *Leptinotarsa* species infestation, relative to an untreated plant. An embodiment is a solanaceous plant having improved resistance to a *Leptinotarsa* species infestation when compared to a control plant, provided by topically applying to the plant or to a seed grown into the plant (or, where the plant is a potato plant, to a seed potato grown into the potato plant) a dsRNA trigger having a sequence selected from the group consisting of: SEQ ID NOs:831-1085, 1095-1104, and 1110-1114, or the complement thereof, or a dsRNA trigger encoded by a sequence selected from the group consisting of SEQ ID NOs:1105-1109. In yet another aspect, this invention is directed to seed (especially transgenic progeny seed) produced by the plant having improved resistance to a *Leptinotarsa* species infestation, as provided by this method. Also contemplated is a commodity product produced by the plant having improved resistance to a *Leptinotarsa* species infestation, as provided by this method, and a commodity product produced from the transgenic progeny seed of such a plant.

Insecticidal Compositions for Controlling *Leptinotarsa* Species

Another aspect of this invention provides an insecticidal composition for controlling a *Leptinotarsa* species comprising an insecticidally effective amount of at least one RNA comprising at least one segment of 18 or more contiguous nucleotides that is essentially identical or complementary to a fragment of a target gene or DNA having a sequence selected from the group consisting of the Target Gene Sequences Group. In this context "controlling" includes inducement of a physiological or behavioural change in a *Leptinotarsa* species (adult or larvae) such as, but not limited to, growth stunting, increased mortality, decrease in reproductive capacity, decrease in or cessation of feeding behavior or movement, or decrease in or cessation of metamorphosis stage development. By "insecticidally effective" is meant effective in inducing a physiological or behavioural change in a *Leptinotarsa* species (adult or larvae) such as, but not limited to, growth stunting, increased mortality, decrease in reproductive capacity or decreased fecundity, decrease in or cessation of feeding behavior or movement, or decrease in or cessation of metamorphosis stage development; in some embodiments, application of an insecticidally effective amount of the RNA to a plant improves the plant's resistance to infestation by a *Leptinotarsa* species. The RNA can be longer than the segment or segments it contains, but each segment and corresponding fragment of a target gene are of equivalent length. RNAs of use in the method can be designed for multiple target genes. Embodiments include those in which the insecticidal composition comprises an insecticidally effective amount of a polynucleotide comprising at least 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene; or an insecticidally effective amount of at least one polynucleotide comprising at least one silencing element that is complementary to at least 21 contiguous nucleotides of a target gene or an RNA transcribed from the target gene, wherein the target gene has a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094; or an insecticidally effective amount of at least one RNA comprising at least one segment that is identical or complementary to at least 21 contiguous nucleotides of a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene; or an RNA molecule that causes mortality or stunting of growth in a *Leptinotarsa* species when ingested or contacted by the *Leptinotarsa* species, wherein the RNA molecule comprises at least 21 contiguous nucleotides that are complementary to a target gene having a nucleotide sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene; or an insecticidal double-stranded RNA molecule that causes mortality or stunting of growth in a *Leptinotarsa* species when ingested or contacted by the *Leptinotarsa* species, wherein at least one strand of the insecticidal double-stranded RNA molecule comprises 21 contiguous nucleotides that are complementary to a target gene or an RNA transcribed from the target gene, wherein the target gene has a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094; or an insecticidally effective amount of at least one double-stranded RNA comprising a sequence selected from the Trigger Sequences Group. In some embodiments, the polynucleotide is a double-stranded RNA. In some embodiments, the polynucleotide (e.g., double-stranded RNA) is chemically synthesized or is produced by expression in a microorganism or by expression in a plant cell. Embodiments include insecticidal compositions comprising a dsRNA having a sequence selected from the group consisting of SEQ ID NOs:831-1085, 1095-1104, and 1110-1114, or the complement thereof, or wherein the insecticidal composition comprises a polynucleotide or RNA encoded by a sequence selected from the group consisting of SEQ ID NOs:1105-1109. Embodiments include those in which the insecticidal composition comprises a dsRNA with a strand having a sequence selected from the group consisting of the Trigger Sequences Group. In an embodiment this invention provides an insecticidal composition for controlling a *Leptinotarsa* species comprising an insecticidally effective amount of a double-stranded RNA molecule that causes mortality or stunting of growth in a *Leptinotarsa* species when ingested or contacted by the *Leptinotarsa* species, wherein the insecticidal double-stranded RNA molecule comprises at least one segment that is complementary to 21 contiguous nucleotides of a DNA having a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the DNA, and wherein the double-stranded RNA molecule is at least 50 base-pairs in length or is between about 100 to about 500 base-pairs in length. In an embodiment this invention provides an insecticidal composition for controlling a *Leptinotarsa* species comprising an insecticidally effective amount of a double-stranded RNA, wherein at least one strand of the double-stranded RNA is complementary to at least 21 contiguous nucleotides of a gene that encodes a ribosomal protein or an RNA transcribed from the gene, wherein the *Leptinotarsa* species is *Leptinotarsa decemlineata*, and wherein RNA interference is induced and *Leptinotarsa decemlineata* mortality occurs, and wherein the ribosomal protein is a ribosomal L7 protein or a protein encoded by SEQ ID NO:730 or wherein the double-stranded RNA comprises a sequence selected from the group consisting of SEQ ID NO:989, 988, 1104, or 1105. Related aspects of the invention include isolated RNAs of use in the composition and plants having improved *Leptinotarsa* resistance provided by treatment with the composition.

In various embodiments, the insecticidal composition for controlling a *Leptinotarsa* species is in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. Suitable binders, inert carriers, surfactants, and the like can optionally be included in the polynucleotide-containing composition, as is known to one skilled in formulation of insecticides and seed treatments. The *Leptinotarsa* species to be controlled is generally a species that infests a plant. In some embodiments, the insecticidal composition is at least one implantable formulation selected from the group consisting of a particulate, pellet, or capsule implanted in the plant; in such embodiments the method comprises implanting in the plant the implantable formulation. In some embodiments, the insecticidal composition is at least one in-furrow formulation selected from the group consisting of a powder, granule, pellet, capsule, spray, or drench, or any other forms suited for applying to a furrow; in such embodiments, the method comprises an in-furrow treatment with the in-furrow formulation. In one embodiment the insecticidal composition can be ingested or otherwise absorbed internally by the *Leptinotarsa* species. For example, the insecticidal composition can be in the form of bait. In some embodiments, the insecticidal composition further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In one embodiment the insecticidal composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. In some embodiments, the insecticidal composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Alternatively such additional components or pesticidal agents can be provided separately, e.g., by separate topical application or by transgenic expression in the plant. Alternatively the plant is topically treated with the insecticidal composition as well as with a separate (preceding, following, or concurrent) application of a substance that improves the efficacy of the insecticidal composition. For example, a plant can be sprayed with a first topical application of a solution containing a nonionic organosilicone surfactant such as SILWET® brand surfactants, e.g., SILWET L-77® brand surfactant, followed by a second topical application of the insecticidal composition, or vice-versa.

It is anticipated that the combination of certain RNAs of use in this method (e.g., the dsRNA triggers described in the working Examples) with one or more non-polynucleotide pesticidal agents will result in a synergetic improvement in prevention or control of *Leptinotarsa* species infestations, when compared to the effect obtained with the RNA alone or the non-polynucleotide pesticidal agent alone. In an embodiment, the insecticidal composition contains one or more RNAs and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, and is found to effect synergistically improved prevention or control of *Leptinotarsa* species infestations.

The *Leptinotarsa* species to be controlled is generally a species that infests a plant. The plant can be any plant that is subject to infestation by a *Leptinotarsa* species. Of particular interest are embodiments wherein the plant is a solanaceous plant (family Solanaceae). Examples include a plant selected from the group consisting of potato, tomato, and eggplant. Embodiments include those wherein the plant is an ungerminated solanaceous plant seed, a solanaceous plant in a vegetative stage, or a solanaceous plant in a reproductive stage. Embodiments include those wherein the plant is a "seed potato", meaning, a potato tuber or piece of potato tuber which can be propagated into new potato plants. In some embodiments, use of the insecticidal composition results in control of the *Leptinotarsa* species, e.g., in growth stunting, increased mortality, decrease in reproductive capacity, decrease in or cessation of feeding behavior or movement, or decrease in or cessation of metamorphosis stage development. In some embodiments, control of the *Leptinotarsa* species is observed as improved growth or improved yields of solanaceous plants treated with the insecticidal composition, in comparison to plants not treated with the insecticidal composition. In some embodiments, control of the *Leptinotarsa* species is observed as decreased numbers of eggs, larvae, or adults of the *Leptinotarsa* species, decreased defoliation or other damage to the plant, or increased yield of harvestable fruit (e.g., tomatoes or eggplants) or tubers (e.g., potatoes).

In various embodiments, the insecticidal composition comprises a microbial cell or is produced in a microorganism. For example, the insecticidal composition can include or can be produced in bacteria or yeast cells. In similar embodiments the insecticidal composition comprises a transgenic plant cell or is produced in a plant cell (for example a plant cell transiently expressing the polynucleotide); such plant cells can be cells in an plant or cells grown in tissue culture or in cell suspension.

The insecticidal composition can be provided for dietary uptake by the *Leptinotarsa* species by applying the composition to a plant or surface subject to infestation by the *Leptinotarsa* species, for example by spraying, dusting, or coating the plant or a seed of the plant or a seed potato, or by application of a soil drench or in-furrow treatment, or by providing in an artificial diet. The insecticidal composition can be provided for dietary uptake by the *Leptinotarsa* species in an artificial diet formulated to meet the particular nutritional requirements for maintaining the *Leptinotarsa* species, wherein the artificial diet is supplemented with some amount of the RNA obtained from a separate source such as chemical synthesis or purified from a microbial fermentation; this embodiment can be useful, e.g., for determining the timing and amounts of effective RNA treatment regimes. In some embodiments the insecticidal composition is provided for dietary uptake by the *Leptinotarsa* species in the form of a plant cell or in plant cell components, or in a microorganism (such as a bacterium or a yeast) or a microbial fermentation product, or in a synthetic diet. In one embodiment the insecticidal composition is provided in the form of bait that is ingested by the *Leptinotarsa* species. The insecticidal composition can be provided for dietary uptake by the *Leptinotarsa* species in the form of a seed (or seed potato) treatment.

In one embodiment the insecticidal composition is provided in the form of any plant that is subject to infestation by a *Leptinotarsa* species, wherein the RNA is contained in or on the plant. Such plants can be stably transgenic plants that express the RNA, or non-transgenic plants that transiently express the RNA or that have been treated with the RNA, e.g., by spraying or coating. Stably transgenic plants generally contain integrated into their genome a recombinant construct that encodes the RNA. Of particular interest are embodiments wherein the plant is a solanaceous plant (family Solanaceae). Examples include a plant selected from the group consisting of: potato, tomato, and eggplant. Embodiments include those wherein the plant is an ungerminated solanaceous plant seed, a solanaceous plant in a vegetative stage, or a solanaceous plant in a reproductive stage. Embodiments include those wherein the plant is a "seed potato", meaning, a potato tuber or piece of potato tuber which can be propagated into new potato plants.

The RNA useful in the insecticidal composition can be single-stranded (ss) or double-stranded (ds). Embodiments include those wherein the RNA is at least one selected from the group consisting of sense single-stranded RNA (ssRNA), anti-sense single-stranded (ssRNA), or double-stranded RNA (dsRNA); a mixture of RNAs of any of these types can be used. In one embodiment a double-stranded DNA/RNA hybrid is used. The RNA can include components other than standard ribonucleotides, e.g., an embodiment is an RNA that comprises terminal deoxyribonucleotides.

The RNA in the insecticidal composition has at least one segment of 18 or more contiguous nucleotides with a sequence of about 95% to about 100% identity with a fragment of equivalent length of a target gene or DNA having a sequence selected from the Target Gene Sequences Group, or the DNA complement thereof. In an embodiment the RNA comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the Target Gene Sequences Group, or the DNA complement thereof. In some embodiments the contiguous nucleotides are exactly (100%) identical to a fragment of equivalent length of a DNA having a sequence selected from the Target Gene Sequences Group, or the DNA complement thereof. In some embodiments, the RNA has an overall sequence of about 95%, about 96%, about 97%, about 98%, about 99%, or about 100% identity with a fragment of a DNA having a sequence selected from the Target Gene Sequences Group, or the DNA complement thereof.

The RNA in the insecticidal composition comprises at least one segment of 18 or more contiguous nucleotides with a sequence of about 95% to about 100% identity with a fragment of equivalent length of a DNA having a sequence selected from the Target Gene Sequences Group or the DNA complement thereof. In some embodiments the RNA comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the RNA comprises at least one segment of at least 21 contiguous nucleotides with a sequence of 100% identity with a fragment of equivalent length of a DNA or target gene having a sequence selected from the Target Gene Sequences Group or the DNA complement thereof. In particular embodiments, the RNA is a double-stranded nucleic acid (e.g., dsRNA) with one strand comprising at least one segment of at least 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In particular embodiments, each segment contained in the RNA is of a length greater than that which is typical of naturally occurring regulatory small RNAs, e.g., each segment is at least about 30 contiguous nucleotides (or base-pairs) in length. In some embodiments, the total length of the RNA, or the length of each segment contained in the RNA, is less than the total length of the sequence of interest (DNA or target gene having a sequence selected from the group consisting of the Target Gene Sequences Group). In some embodiments, the total length of the RNA is between about 50 to about 500 nucleotides (for single-stranded RNAs) or base-pairs (for double-stranded RNAs). In some embodiments, the RNA comprises at least one RNA strand of between about 50 to about 500 nucleotides in length. Embodiments include those in which the RNA comprises at least one segment having a sequence selected from the group consisting of: SEQ ID NOs:831-1085, 1095-1104, and 1110-1114, or the complement thereof, or wherein the RNA is encoded by a sequence selected from the group consisting of SEQ ID NOs:1105-1109.

The RNA in the insecticidal composition is generally designed to suppress one or more genes ("target genes").

Such target genes can include coding or non-coding sequence or both. In specific embodiments, the RNA is designed to suppress one or more target genes, where each target gene has a DNA sequence selected from the group consisting of the Target Gene Sequences Group. In various embodiments, the RNA is designed to suppress one or more genes, where each gene has a sequence selected from the group consisting of the Target Gene Sequences Group, and can be designed to suppress multiple genes from this group, or to target different regions of one or more of these genes. In an embodiment, the RNA comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence, and can be sense or anti-sense relative to the target gene. For example, in one embodiment the RNA can include multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof; the segments can be from different regions of the target gene, e.g., the segments can correspond to different exon regions of the target gene, and "spacer" nucleotides which do not correspond to a target gene can optionally be used in between or adjacent to the segments.

The total length of the RNA in the insecticidal composition can be greater than 18 contiguous nucleotides, and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the RNA can be greater than the length of the section or segment of the RNA designed to suppress one or more target genes, where each target gene has a DNA sequence selected from the group consisting of the Target Gene Sequences Group. For example, the RNA can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the RNA comprises additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the RNA comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the RNA comprises one such segment, with an additional 5' G or an additional 3' C or both, adjacent to the segment. In another embodiment, the RNA is a double-stranded RNA comprising additional nucleotides to form an overhang, for example, a dsRNA comprising 2 deoxyribonucleotides to form a 3' overhang. Thus in various embodiments, the nucleotide sequence of the entire RNA is not 100% identical or complementary to a fragment of contiguous nucleotides in the DNA or target gene having a sequence selected from the group consisting of the Target Gene Sequences Group. For example, in some embodiments the RNA comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In various embodiments the RNA in the insecticidal composition consists of naturally occurring ribonucleotides. Embodiments include, for example, synthetic RNAs consisting wholly of ribonucleotides or mainly of ribonucleotides but with one or more terminal deoxyribonucleotides or one or more terminal dideoxyribonucleotides. In certain embodiments, the RNA comprises non-canonical nucleotides such as inosine, thiouridine, or pseudouridine. In certain embodiments, the RNA comprises chemically modified nucleotides. (a) The RNA in the insecticidal composition is provided by suitable means known to one in the art. Embodiments include those wherein the RNA is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In some embodiments the RNA is provided as an isolated RNA that is not part of an expression construct. In some embodiments the RNA is provided as an isolated RNA that is lacking additional elements such as a promoter or terminator sequences. Such RNAs can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively the RNA can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as including additional RNA encoding an aptamer or ribozyme or an expression cassette for expressing a gene of interest (e.g., an insecticidal protein).

Methods of Providing Plants Having Improved Resistance to *Leptinotarsa* Species Infestations, and the Plants and Seeds Thus Provided Another aspect of this invention is directed to a method of providing a plant having improved resistance to a *Leptinotarsa* species infestation comprising expressing in the plant at least one polynucleotide comprising at least one segment of 18 or more contiguous nucleotides that is essentially identical or complementary to a fragment of a target gene or DNA having a sequence selected from the group consisting of the Target Gene Sequences Group, whereby the resulting plant has improved resistance to a *Leptinotarsa* species when compared to a control plant in which the polynucleotide is not expressed. In an embodiment, the method comprises expressing in the plant at least one polynucleotide comprising at least one segment of 18 or more contiguous nucleotides with a sequence of about 95% to about 100% identity with a fragment of equivalent length of a target gene or DNA having a sequence selected from the Target Gene Sequences Group or the DNA complement thereof. In an embodiment, the invention provides a method of providing a plant having improved resistance to a *Leptinotarsa* species infestation comprising expressing in the plant at least one polynucleotide comprising at least one segment that is identical or complementary to at least 21 contiguous nucleotides of a DNA having a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094. By "expressing a polynucleotide in the plant" is generally meant "expressing an RNA transcript in the plant", e.g., expressing in the plant an RNA comprising a ribonucleotide sequence that is anti-sense or essentially complementary to at least a fragment of a target gene or DNA having a sequence selected from the group consisting of the Target Gene Sequences Group. Embodiments include those in which the polynucleotide expressed in the plant is an RNA comprising at least one segment having a sequence selected from the group consisting of: SEQ ID NOs:831-1085, 1095-1104, and 1110-1114, or the complement thereof, or wherein polynucleotide expressed in the plant is an RNA hairpin encoded by a sequence selected from the group consisting of SEQ ID NOs:1105-1109. Embodiments include those in which the polynucleotide expressed in the plant comprises a dsRNA with a strand having a sequence selected from the group consisting of the Trigger Sequences Group. However, the polynucleotide expressed in the plant can also be DNA (e.g., a DNA produced in the plant during genome replication), or the RNA encoded by such DNA. Related aspects of the invention include isolated polynucleotides of use in the method and plants having improved *Leptinotarsa* resistance provided by the method.

The method comprises expressing at least one polynucleotide in a plant, wherein the polynucleotide comprises at least one segment of 18 or more contiguous nucleotides that is essentially identical or complementary to a fragment of a target gene or DNA having a sequence selected from the group consisting of the Target Gene Sequences Group. In some embodiments, a first polynucleotide is provided to a plant in the form of DNA (e.g., in the form of an isolated DNA molecule, or as an expression construct, or as a transformation vector), and the polynucleotide expressed in the plant is a second polynucleotide (e.g., the RNA transcript of the first polynucleotide) in the plant. In an embodiment, the polynucleotide is expressed in the plant by transgenic expression, i.e., by stably integrating the polynucleotide into the plant's genome from where it can be expressed in a cell or cells of the plant. In an embodiment, a first polynucleotide (e.g., a recombinant DNA construct comprising a promoter operably linked to DNA comprising at least one segment of 18 or more contiguous nucleotides that is essentially identical or complementary to a fragment of a target gene or DNA having a sequence selected from the group consisting of the Target Gene Sequences Group) is stably integrated into the plant's genome from where secondarily produced polynucleotides (e.g., an RNA transcript comprising the transcript of the segment of 18 or more contiguous nucleotides that is essentially identical or complementary to a fragment of a target gene or DNA having a sequence selected from the group consisting of the Target Gene Sequences Group) are expressed in a cell or cells of the plant. Methods of providing stably transformed plants are provided in the section headed "Making and Using Transgenic Plant Cells and Transgenic Plants".

In another embodiment the polynucleotide expressed in the plant is expressed by transient expression (i.e., expression not resulting from stable integration of a sequence into the plant's genome). In such embodiments the method can include a step of introducing a polynucleotide (e.g., dsRNA or dsDNA) into the plant by routine techniques known in the art. For example, transient expression can be accomplished by infiltration of a polynucleotide solution using a needleless syringe into a leaf of a plant.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant. In some embodiments, the first polynucleotide is one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In specific embodiments, a first polynucleotide is introduced into the plant by topical application to the plant of a polynucleotide-containing composition in a suitable form, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or in the form of a treatment of a solanaceous plant seed or treatment of a seed potato. Suitable binders, inert carriers, surfactants, and the like can optionally be included in the composition, as is known to one skilled in formulation of pesticides and seed treatments. In such embodiments, the polynucleotide-containing composition can further include one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator; in one embodiment the composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. In some embodiments, the topically applied composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Alternatively such additional components or pesticidal agents can be provided separately, e.g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants, e.g., SILWET L-77® brand surfactant, followed by a second topical application of the polynucleotide-containing composition, or vice-versa.

It is anticipated that the combination of certain polynucleotides of use in this method (e.g., the polynucleotide triggers described in the working Examples) with one or more non-polynucleotide pesticidal agents will result in a synergetic improvement in prevention or control of Leptinotarsa species infestations, when compared to the effect obtained with the polynucleotide alone or the non-polynucleotide pesticidal agent alone. In an embodiment, a transgenic plant expressing at least one polynucleotide comprising at least one segment of 18 or more contiguous nucleotides that is essentially identical or complementary to a fragment of a target gene or DNA having a sequence selected from the group consisting of the Target Gene Sequences Group (e.g., the polynucleotide triggers described in the working Examples) and one or more genes encoding a non-polynucleotide pesticidal agent selected from the group consisting of a patatin, a plant lectin, a phytoecdysteroid, a Bacillus thuringiensis insecticidal protein, a Xenorhabdus insecticidal protein, a Photorhabdus insecticidal protein, a Bacillus laterosporous insecticidal protein, and a Bacillus sphaericus insecticidal protein, is found to exhibit synergistically improved resistance to Leptinotarsa species infestations.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant; the site of application of the first polynucleotide need not be the same site where the second polynucleotide is transiently expressed. For example, a first polynucleotide can be provided to a plant by topical application onto a leaf, or by injection into a stem, and the second polynucleotide can be transiently expressed elsewhere in the plant, e.g., in the roots or throughout the plant. In some embodiments of the method, a composition comprising at least one polynucleotide is topically applied to above-ground parts of the plant, e.g., sprayed or dusted onto leaves, stems, and flowering parts of the plant. In other embodiments, a composition comprising at least one polynucleotide is topically applied to below-ground parts of the plant, such as to the roots, e.g., by means of a soil drench. In other embodiments, a composition comprising at least one polynucleotide is topically applied to a seed (or, in the case of potatoes, topically applied to a seed potato) that is grown into the plant having improved resistance to a Leptinotarsa species infestation. In some embodiments the polynucleotide expressed in the plant is RNA, which can be single-stranded (ss) or double-stranded (ds) RNA or a combination of both.

In some embodiments a first polynucleotide (DNA or RNA or both) is provided to a plant and a second polynucleotide having a sequence corresponding (identical or complementary) to the first polynucleotide is subsequently expressed in the plant. In such embodiments the polynucleotide expressed in the plant is an RNA transcript which can be ssRNA or dsRNA or a combination of both. In some embodiments where the polynucleotide is expressed by transient expression, a first polynucleotide is provided to a plant in the form of RNA or DNA or both RNA and DNA, and a secondarily produced second polynucleotide is transiently expressed in the plant; in such embodiments, the first polynucleotide one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In such embodiments where the polynucleotide is expressed by transient expression the first polynucleotide can consist of naturally occurring nucleotides, such as those which occur in DNA and RNA. In such embodiments where the polynucleotide is expressed by transient expression the first polynucleotide can be chemically modified, or comprises chemically modified nucleotides. The first polynucleotide is provided by suitable means known to one in the art. Embodiments include those wherein the first polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation. The first polynucleotide can be provided as an RNA or DNA fragment. Alternatively the first polynucleotide can be provided in more complex constructs, e.g., as part of a recombinant expression construct, or included in a recombinant vector, for example in a recombinant plant virus vector or in a recombinant baculovirus vector; such recombinant expression constructs or vectors can be designed to include additional elements, such as expression cassettes for expressing a gene of interest (e.g., an insecticidal protein).

In some embodiments the polynucleotide expressed in the plant is an RNA molecule and can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., an insecticidal protein).

The polynucleotide expressed in the plant has at least one segment of 18 or more contiguous nucleotides with a sequence of about 95% to about 100% identity with a fragment of equivalent length of a DNA having a sequence selected from the Target Gene Sequences Group or the DNA complement thereof. In an embodiment the polynucleotide expressed in the plant comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the Target Gene Sequences Group or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the polynucleotide expressed in the plant has an overall sequence of about 95%, about 96%, about 97%, about 98%, about 99%, or about 100% identity with a fragment of a DNA having a sequence selected from the Target Gene Sequences Group or the DNA complement thereof.

The polynucleotide expressed in the plant is generally designed to suppress one or more genes ("target genes"). Such target genes can include coding or non-coding sequence or both. In specific embodiments, the polynucleotide expressed in the plant is designed to suppress one or more target genes, where each target gene has a DNA sequence selected from the group consisting of the Target Gene Sequences Group. In various embodiments, the polynucleotide expressed in the plant is designed to suppress one or more genes, where each gene has a sequence selected from the group consisting of the Target Gene Sequences Group, and can be designed to suppress multiple genes from this group, or to target different regions of one or more of these genes. In an embodiment, the polynucleotide expressed in the plant comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence, and can be sense or anti-sense relative to the target gene. For example, in one embodiment the polynucleotide expressed in the plant can include multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof the segments can be from different regions of the target gene, e.g., the segments can correspond to different exon regions of the target gene, and "spacer" nucleotides which do not correspond to a target gene can optionally be used in between or adjacent to the segments.

The total length of the polynucleotide expressed in the plant can be greater than 18 contiguous nucleotides, and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the polynucleotide expressed in the plant can be greater than the length of the section or segment of the polynucleotide designed to suppress one or more target genes, where each target gene has a DNA sequence selected from the group consisting of the Target Gene Sequences Group. For example, the polynucleotide expressed in the plant can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide expressed in the plant comprises additional nucleotides that are not specifically related (i.e., having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the polynucleotide expressed in the plant comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the polynucleotide expressed in the plant comprises one such segment, with an additional 5' G or an additional 3' C or both, adjacent to the segment. In another embodiment, the polynucleotide expressed in the plant is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide expressed in the plant is not 100% identical or complementary to a fragment of contiguous nucleotides in the DNA or target gene having a sequence selected from the group consisting of the Target Gene Sequences Group. For example, in some embodiments the polynucleotide expressed in the plant comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In a related aspect, this invention is directed to the plant having improved resistance to a *Leptinotarsa* species infestation, provided by expressing in the plant at least one polynucleotide comprising at least one segment of 18 or more contiguous nucleotides that are essentially identical or complementary to a fragment of equivalent length of a DNA having a sequence selected from the group consisting of the Target Gene Sequences Group, whereby the resulting plant has improved resistance to a *Leptinotarsa* species infestation when compared to a control plant in which the polynucleotide is not expressed. In a related aspect, this invention is directed to the plant having improved resistance to a *Leptinotarsa* species infestation, provided by expressing in the plant at least one polynucleotide comprising at least one segment of 18 or more contiguous nucleotides with a sequence of about 95% to about 100% identity with a fragment of equivalent length of a DNA having a sequence selected from the Target Gene Sequences Group or the DNA complement thereof, whereby the resulting plant has improved resistance to a *Leptinotarsa* species infestation when compared to a control plant in which the polynucleotide is not expressed. An embodiment is a solanaceous plant having improved resistance to a *Leptinotarsa* species infestation when compared to a control plant, provided by expressing in the plant an RNA having a sequence selected from the group consisting of: SEQ ID NOs:831-1085, 1095-1104, and 1110-1114, or the complement thereof, or expressing in the plant an RNA hairpin encoded by a sequence selected from the group consisting of SEQ ID NOs:1105-1109. In yet another aspect, this invention is directed to seed (especially transgenic progeny seed) produced by the plant having improved resistance to a *Leptinotarsa* species infestation, as provided by this method. Also contemplated is a commodity product produced by the plant having improved resistance to a *Leptinotarsa* species infestation, as provided by this method, and a commodity product produced from the transgenic progeny seed of such a plant.

Recombinant DNA Constructs for Controlling a *Leptinotarsa* Species

Another aspect of this invention provides a recombinant DNA construct comprising a heterologous promoter operably linked to a DNA element comprising at least one segment of 18 or more contiguous nucleotides with a sequence of about 95% to about 100% identity with a fragment of a DNA having a sequence selected from the Target Gene Sequences Group, or the DNA complement thereof. In some embodiments, the recombinant DNA construct comprises a heterologous promoter operably linked to: (a) DNA comprising a nucleotide sequence that is complementary to at least 21 contiguous nucleotides of a target gene having a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or an RNA transcribed from the target gene; or (b) a DNA comprising 21 or more contiguous nucleotides having 100% identity to a fragment of equivalent length of a DNA having a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094, or the DNA complement thereof; or (c) DNA encoding at least one silencing element that is complementary to at least 21 contiguous nucleotides of a target gene or an RNA transcribed from the target gene, wherein the target gene has a sequence selected from the group consisting of: SEQ ID NO:730, SEQ ID NO:807, SEQ ID NOs:1-725, SEQ ID NOs:726-729, SEQ ID NOs:731-806, SEQ ID NOs:808-830, and SEQ ID NOs:1087-1094; or (d) DNA encoding at least one silencing element comprising at least 21 contiguous nucleotides that are complementary to a target gene selected from the genes in the Target Gene Sequences Group or an RNA transcribed from the target gene; or (e) DNA encoding a RNA comprising at least 21 contiguous nucleotides that are complementary to a nucleotide sequence selected from the Trigger Sequences Group, or the complement thereof, or an orthologous nucleotide sequence from a *Leptinotarsa* species or a *Tribolium* species, wherein the orthologous nucleotide sequence has at least 95% sequence identity with a nucleotide sequence selected from the Trigger Sequences Group, wherein the percentage sequence identity is calculated over the same length; or (f) DNA encoding a RNA comprising at least one double-stranded RNA region, at least one strand of which comprises at least 21 contiguous nucleotides that are complementary to a nucleotide sequence selected from the Trigger Sequences Group, or the complement thereof, or an orthologous nucleotide sequence from a *Leptinotarsa* species or a *Tribolium* species, wherein the orthologous nucleotide sequence has at least 95% sequence identity with a nucleotide sequence selected from the group consisting of the Trigger Sequences Group, wherein the percentage sequence identity is calculated over the same length; or (g) DNA encoding RNA comprising a nucleotide sequence selected from the Trigger Sequences Group, or the complement thereof. Embodiments include a recombinant DNA construct comprising a heterologous promoter operably linked to a DNA element encoding an RNA having a sequence selected from the group consisting of: SEQ ID NOs:831-1085, 1095- 1104, and 1110-1114, or the complement thereof, or comprising a heterologous promoter operably linked to a DNA element encoding an RNA hairpin encoded by a sequence selected from the group consisting of SEQ ID NOs:1105- 1109. Embodiments include a recombinant DNA construct comprising a heterologous promoter operably linked to a DNA encoding a dsRNA with a strand having a sequence selected from the group consisting of the Trigger Sequences Group. The recombinant DNA constructs are useful in providing a plant having improved resistance to a *Leptinotarsa* species infestation, e.g., by expressing in a plant a transcript of such a recombinant DNA construct. The recombinant DNA constructs are also useful in the manufacture of polynucleotides useful in making compositions that can be applied to a plant, seed, propagatable plant part, soil or field, or surface in need of protection from a *Leptinotarsa* species infestation. Related aspects of the invention include: compositions comprising the recombinant DNA construct; a plant chromosome or a plastid or a recombinant plant virus vector or a recombinant baculovirus vector comprising the recombinant DNA construct; a transgenic solanaceous plant cell having in its genome the recombinant DNA construct, optionally comprising in its genome DNA encoding at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, and a transgenic solanaceous plant including such a transgenic solanaceous plant cell, or a fruit, seed, or propagatable part of the transgenic solanaceous plant; and plants having improved *Leptinotarsa* resistance provided by expression of or treatment with the recombinant DNA construct or the RNA encoded therein.

The recombinant DNA construct comprises a heterologous promoter operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. In some embodiments, the segment of 18 or more contiguous nucleotides has a sequence with about 95%, about 96%, about 97%, about 98%, about 99%, or about 100% identity with a fragment of a DNA having a sequence selected from the Target Gene Sequences Group or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the DNA has an overall sequence of about 95%, about 96%, about 97%, about 98%, about 99%, or about 100% identity with a DNA having a sequence selected from the Target Gene Sequences Group or the DNA complement thereof.

The recombinant DNA construct therefore comprises a heterologous promoter operably linked to DNA comprising at least one segment of 18 or more contiguous nucleotides designed to suppress expression of a target gene having a sequence selected from the Target Gene Sequences Group or the DNA complement thereof. In some embodiments the DNA comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the DNA encodes an RNA containing at least one segment of at least 21 contiguous nucleotides with a sequence of 100% identity with a fragment of equivalent length of a DNA or target gene having a sequence selected from the Target Gene Sequences Group or the DNA complement thereof. In particular embodiments, the DNA encodes a double-stranded nucleic acid (e.g., dsRNA) with one strand comprising at least one segment of at least 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In particular embodiments, each segment contained in the DNA is of a length greater than that which is typical of naturally occurring regulatory small RNAs. In some embodiments, each segment is at least about 30 contiguous nucleotides (or base-pairs) in length. In some embodiments, the total length of the DNA, or the length of each segment contained in the polynucleotide, is less than the total length of the sequence of interest (DNA or target gene having a sequence selected from the group consisting of the Target Gene Sequences Group). In some embodiments, the total length of the DNA is between about 50 to about 500. In some embodiments, the DNA encodes an RNA having a sequence selected from the group consisting of: SEQ ID NOs:831-1085, 1095-1104, and 1110-1114, or the complement thereof. In some embodiments, the recombinant DNA construct comprises a sequence selected from the group consisting of SEQ ID NOs:1105-1109.

The recombinant DNA construct comprises a heterologous promoter operably linked to DNA generally designed to suppress one or more genes ("target genes"). Such target genes can include coding or non-coding sequence or both. In specific embodiments, the recombinant DNA construct is designed to suppress one or more target genes, where each target gene has a DNA sequence selected from the group consisting of the Target Gene Sequences Group. In various embodiments, the recombinant DNA construct is designed to suppress one or more genes, where each gene has a sequence selected from the group consisting of the Target Gene Sequences Group, and can be designed to suppress multiple genes from this group, or to target different regions of one or more of these genes. In an embodiment, the recombinant DNA construct comprises a heterologous promoter operably linked to multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence, and can be sense or anti-sense relative to the target gene. For example, in one embodiment the recombinant DNA construct can include a heterologous promoter operably linked to multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof the segments can be from different regions of the target gene, e.g., the segments can correspond to different exon regions of the target gene, and "spacer" nucleotides which do not correspond to a target gene can optionally be used in between or adjacent to the segments.

The recombinant DNA construct comprises a heterologous promoter operably linked to DNA which can have a total length that is greater than 18 contiguous nucleotides, and can include nucleotides in addition to the segment of at least one segment of 18 or more contiguous nucleotides having the sequence of about 95% to about 100% identity with a fragment of equivalent length of a DNA having a sequence selected from the Target Gene Sequences Group or the DNA complement thereof. In other words, the total length of the DNA can be greater than the length of the segment of the DNA designed to suppress one or more target genes, where each target gene has a DNA sequence selected from the group consisting of the Target Gene Sequences Group. For example, the DNA can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the heterologous promoter is operably linked to DNA comprising additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the heterologous promoter is operably linked to DNA comprising additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the heterologous promoter is operably linked to DNA comprising one such segment, with an additional 5' G or an additional 3' C or both, adjacent to the segment. In another embodiment, the heterologous promoter is operably linked to DNA encoding a double-stranded RNA comprising additional nucleotides to form an overhang. Thus in various embodiments, the nucleotide sequence of the entire DNA operably linked to the heterologous promoter is not 100% identical or complementary to a fragment of contiguous nucleotides in the DNA or target gene having a sequence selected from the group consisting of the Target Gene Sequences Group. For example, in some embodiments the heterologous promoter is operably linked to DNA comprising at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In recombinant DNA constructs, the heterologous promoter is operably linked to DNA that encodes a transcript that can be single-stranded (ss) or double-stranded (ds) or a combination of both. Embodiments of the method include those wherein the DNA encodes a transcript comprising sense single-stranded RNA (ssRNA), anti-sense ssRNA, or double-stranded RNA (dsRNA), or a combination of any of these.

The recombinant DNA construct is provided by suitable means known to one in the art. Embodiments include those wherein the recombinant DNA construct is synthesized in vitro, produced by expression in a microorganism or in cell culture (such as plant or insect cells grown in culture), produced by expression in a plant cell, or produced by microbial fermentation.

The heterologous promoter of use in recombinant DNA constructs is selected from the group consisting of a promoter functional in a plant, a promoter functional in a prokaryote, a promoter functional in a fungal cell, and a baculovirus promoter. Non-limiting examples of promoters are described in the section headed "Promoters".

In some embodiments, the recombinant DNA construct comprises a second promoter also operably linked to the DNA. For example, the DNA comprising at least one segment of 18 or more contiguous nucleotides can be flanked by two promoters arranged so that the promoters transcribe in opposite directions and in a convergent manner, yielding opposite-strand transcripts of the DNA that are complementary to and capable of hybridizing with each other to form double-stranded RNA. In one embodiment, the DNA is located between two root-specific promoters, which enable transcription of the DNA in opposite directions, resulting in the formation of dsRNA.

In some embodiments the recombinant DNA construct comprises other DNA elements in addition to the heterologous promoter operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. Such DNA elements are known in the art, and include but are not limited to introns, recombinase recognition sites, aptamers or ribozymes, additional and additional expression cassettes for expressing coding sequences (e.g., to express a transgene such as an insecticidal protein or selectable marker) or non-coding sequences (e.g., to express additional suppression elements). Inclusion of one or more recognition sites for binding and cleavage by a small RNA (e.g., by a miRNA or an siRNA that is expressed only in a particular cell or tissue) allows for more precise expression patterns in a plant, wherein the expression of the recombinant DNA construct is suppressed where the small RNA is expressed.

In some embodiments, the recombinant DNA construct is provided in a recombinant vector. By "recombinant vector" is meant a recombinant polynucleotide molecule that is used to transfer genetic information from one cell to another. Embodiments suitable to this invention include, but are not limited to, recombinant plasmids, recombinant cosmids, artificial chromosomes, and recombinant viral vectors such as recombinant plant virus vectors and recombinant baculovirus vectors. Alternative embodiments include recombinant plasmids, recombinant cosmids, artificial chromosomes, and recombinant viral vectors such as recombinant plant virus vectors and recombinant baculovirus vectors comprising the DNA element without the heterologous promoter.

In some embodiments, the recombinant DNA construct is provided in a plant chromosome or plastid, e.g., in a transgenic plant cell or a transgenic plant. Thus, also encompassed by this invention is a transgenic plant cell having in its genome the recombinant DNA construct, as well as a transgenic plant or partially transgenic plant including such a transgenic plant cell. Partially transgenic plants include, e.g., a non-transgenic scion grafted onto a transgenic rootstock including the transgenic plant cell. Embodiments include a transgenic tomato rootstock including the transgenic plant cell. The plant can be any plant that is subject to infestation by a *Leptinotarsa* species. Of particular interest are embodiments wherein the plant is a solanaceous plant (family Solanaceae). Examples include a plant selected from the group consisting of potato, tomato, and eggplant. Embodiments include those wherein the plant is an ungerminated solanaceous plant seed, a solanaceous plant in a vegetative stage, or a solanaceous plant in a reproductive stage. Embodiments include those wherein the plant is a "seed potato", meaning a potato tuber or piece of potato tuber which can be propagated into new potato plants. In yet another aspect, this invention is directed to seed (especially transgenic progeny seed) produced by the transgenic plant having in its genome a recombinant DNA construct as described herein. Embodiments also encompass a transgenic seed potato having in its genome a recombinant DNA construct as described herein. Also contemplated is a commodity product produced by such a transgenic plant, and a commodity product produced from the transgenic progeny seed of such a transgenic plant.

The recombinant DNA construct can be provided in a composition for topical application to a surface of a plant or of a plant seed, or for topical application to any substrate needing protection from a *Leptinotarsa* species infestation. Likewise, the recombinant DNA construct can be provided in a composition for topical application to a *Leptinotarsa* species, or in a composition for ingestion by a *Leptinotarsa* species. In various embodiments, such compositions containing the recombinant DNA construct are provided in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. The topical application can be in the form of topical treatment of fruits of solanaceous plants or seeds from fruits of solanaceous plants, or in the form of topical treatment of "seed potato" tubers or pieces of tuber (e.g., by soaking, coating, or dusting the seed potato). Suitable binders, inert carriers, surfactants, and the like can be included in the composition containing the recombinant DNA construct, as is known to one skilled in formulation of pesticides and seed treatments. In some embodiments, the composition for topical application containing the recombinant DNA construct is at least one topically implantable formulation selected from the group consisting of a particulate, pellet, or capsule topically implanted in the plant; in such embodiments the method comprises topically implanting in the plant the topically implantable formulation. In some embodiments, the composition for topical application containing the recombinant DNA construct is at least one in-furrow formulation selected from the group consisting of a powder, granule, pellet, capsule, spray, or drench, or any other forms suited for topically applying to a furrow; in such embodiments, the method includes an in-furrow treatment with the in-furrow formulation. In one embodiment the composition for topical application containing the recombinant DNA construct can be ingested or otherwise absorbed internally by the *Leptinotarsa* species. For example, the composition for topical application containing the recombinant DNA construct can be in the form of bait. In some embodiments, the composition containing the recombinant DNA construct further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In one embodiment the composition containing the recombinant DNA construct further comprises a non-ionic organosilicone surfactant such as SILWET® brand surfactants, e.g., SILWET L-77® brand surfactant having CAS Number 27306-78-1 and EPA Number: CAL. REG.NO. 5905-50073-AA, currently available from Momentive Performance Materials, Albany, N.Y. In some embodiments, the composition containing the recombinant DNA construct further comprises at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

It is anticipated that the combination of certain recombinant DNA constructs as described herein (e.g., recombinant DNA constructs including the polynucleotide triggers described in the working Examples), whether transgenically expressed or topically applied, with one or more non-polynucleotide pesticidal agents, whether transgenically expressed or topically applied, will result in a synergetic improvement in prevention or control of *Leptinotarsa* species infestations, when compared to the effect obtained with the recombinant DNA constructs alone or the non-polynucleotide pesticidal agent alone. In an embodiment, a recombinant DNA construct for expressing one or more polynucleotides as well as one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to provide synergistically improved resistance to *Leptinotarsa* species infestations in plants expressing the recombinant DNA construct. An embodiment relates to a recombinant DNA construct for expressing an RNA comprising a segment having a sequence selected from the group consisting of SEQ ID NOs:831-1085 and 1095 as well as one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

The composition containing the recombinant DNA construct can be provided for dietary uptake by a *Leptinotarsa* species by applying the composition to a plant or surface subject to infestation by the *Leptinotarsa* species, for example by spraying, dusting, or coating the plant, or by application of a soil drench, or by providing in an artificial diet. The composition containing the recombinant DNA construct can be provided for dietary uptake by a *Leptinotarsa* species in an artificial diet formulated to meet the particular nutritional requirements for maintaining the *Leptinotarsa* species, wherein the artificial diet is supplemented with some amount of the recombinant DNA construct obtained from a separate source such as in vitro synthesis or purified from a microbial fermentation or other biological source; this embodiment can be useful, e.g., for determining the timing and amounts of effective treatment regimes. In some embodiments the composition containing the recombinant DNA construct is provided for dietary uptake by the *Leptinotarsa* species in the form of a plant cell or in plant cell components, or in a microorganism (such as a bacterium or a yeast) or a microbial fermentation product, or in a synthetic diet. In one embodiment the composition containing the recombinant DNA construct is provided in the form of bait that is ingested by the *Leptinotarsa* species. The composition containing the recombinant DNA construct can be provided for dietary uptake by the *Leptinotarsa* species in the form of a seed treatment.

In various embodiments, the composition containing the recombinant DNA construct comprises a microbial cell or is produced in a microorganism. For example, the composition for containing the recombinant DNA construct can include or can be produced in bacteria or yeast cells. In similar embodiments the composition containing the recombinant DNA construct comprises a transgenic plant cell or is produced in a plant cell (for example a plant cell transiently expressing the recombinant DNA construct); such plant cells can be cells in an plant or cells grown in tissue culture or in cell suspension.

Transgenic Solanaceous Plant Cells

Several embodiments relate to transgenic solanaceous plant cells expressing a polynucleotide useful in the methods described herein for suppressing expression of a target gene in a *Leptinotarsa* species or for controlling a *Leptinotarsa* infestation. In one aspect this invention provides a transgenic solanaceous plant cell having in its genome a recombinant DNA encoding RNA comprising at least one segment of 18 or more contiguous nucleotides with a sequence of about 95% to about 100% identity with a fragment of a DNA having a sequence selected from the Target Gene Sequences Group, or the DNA complement thereof. In one aspect this invention provides a transgenic solanaceous plant cell having in its genome a recombinant DNA encoding RNA comprising at least one silencing element essentially identical or essentially complementary to a fragment of a target gene sequence of the *Leptinotarsa* species larvae, wherein the target gene sequence is selected from the Target Gene Sequences Group, or the DNA complement thereof. In one aspect this invention provides a transgenic solanaceous plant cell having in its genome a recombinant DNA encoding RNA that suppresses expression of a target gene in a *Leptinotarsa* species that contacts or ingests the RNA, wherein the RNA comprises at least one silencing element having at least one segment of 18 or more contiguous nucleotides complementary to a fragment of the target gene, and wherein the target gene is selected from the group consisting of the genes in the Target Gene Sequences Group. A specific embodiment is a transgenic solanaceous plant cell having in its genome a recombinant DNA encoding RNA that suppresses expression of a target gene in a *Leptinotarsa* species that contacts or ingests the RNA, wherein the RNA comprises at least one silencing element having at least one segment of 18 or more contiguous nucleotides complementary to a fragment of one or more exocyst target genes; suitable exocyst target genes include the *Leptinotarsa* exocyst genes provided in Table 4 or homologous sequences identified from other insect species. In one aspect this invention provides a transgenic solanaceous plant cell having in its genome a recombinant DNA encoding an RNA having a sequence selected from the group consisting of: SEQ ID NOs:831-1085, 1095-1104, and 1110-1114, or the complement thereof, or a recombinant DNA selected from the group consisting of SEQ ID NOs:1105-1109; embodiments include a transgenic solanaceous plant cell having in its genome a recombinant DNA encoding a dsRNA with a strand having a sequence selected from the group consisting of the Trigger Sequences Group. Such transgenic solanaceous plant cells are useful in providing a transgenic solanaceous plant having improved resistance to a *Leptinotarsa* species infestation when compared to a control plant lacking such plant cells. The transgenic solanaceous plant cell can an isolated transgenic solanaceous plant cell, or a transgenic solanaceous plant cell grown in culture, or a transgenic cell of any transgenic solanaceous plant that is subject to infestation by a *Leptinotarsa* species. Examples include a transgenic solanaceous plant selected from the group consisting of potato, tomato, and eggplant. Embodiments include those wherein the transgenic solanaceous plant is an ungerminated transgenic solanaceous plant seed, a transgenic solanaceous plant in a vegetative stage, or a transgenic solanaceous plant in a reproductive stage. Embodiments include those wherein the transgenic solanaceous plant is a potato tuber or piece of potato tuber ("seed potato") which can be propagated into new transgenic potato plants.

In an embodiment, the recombinant DNA is stably integrated into the transgenic solanaceous plant's genome from where it can be expressed in a cell or cells of the transgenic solanaceous plant. Methods of providing stably transformed plants are provided in the section headed "Making and Using Transgenic Plant Cells and Transgenic Plants".

Several embodiments relate to a transgenic solanaceous plant cell having in its genome a recombinant DNA encoding RNA that suppresses expression of a target gene in a *Leptinotarsa* species that contacts or ingests the RNA, wherein the RNA comprises at least one silencing element complementary to the target gene, and wherein the target gene sequence is selected from the Target Gene Sequences Group or the complement thereof. In some embodiments, the silencing element comprises at least one 18 or more contiguous nucleotides with a sequence of about 95% to about 100% complementarity to a fragment of equivalent length of a DNA having a sequence selected from the group consisting of the Target Gene Sequences Group. In some embodiments, the silencing element comprises at least one 18 or more contiguous nucleotides capable of hybridizing in vivo or of hybridizing under physiological conditions (e.g., such as physiological conditions normally found in the cells of a *Leptinotarsa* species) to a fragment of equivalent length of a DNA having a sequence selected from the group consisting of the Target Gene Sequences Group. The contiguous nucleotides number at least 18, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the silencing element comprises at least one segment of at least 21 contiguous nucleotides with a sequence of 100% identity with a fragment of equivalent length of a DNA or target gene having a sequence selected from the Target Gene Sequences Group or the DNA complement thereof. In particular embodiments, the RNA is a double-stranded nucleic acid (e.g., dsRNA) with one strand comprising at least one segment of at least 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In particular embodiments, each silencing element contained in the RNA is of a length greater than that which is typical of naturally occurring regulatory small RNAs. In some embodiments, each segment is at least about 30 contiguous nucleotides (or base-pairs) in length. In particular embodiments, the RNA is between about 50 to about 500 nucleotides in length. In particular embodiments, the RNA has a sequence selected from the group consisting of: SEQ ID NOs:831-1085, 1095-1104, and 1110-1114, or the complement thereof, or the RNA is encoded by a sequence selected from the group consisting of SEQ ID NOs:1105-1109.

In some embodiments, the transgenic solanaceous plant cell is further capable expressing additional heterologous DNA sequences. In an embodiment, the transgenic solanaceous plant cell has a genome that further comprises recombinant DNA encoding at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. In particular embodiments, the transgenic solanaceous plant cell has stably integrated in its genome (i) recombinant DNA encoding at least one RNA with a sequence selected from the group consisting of SEQ ID NOs:831-1085 and 1095 and (ii) DNA encoding at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

In a related aspect, this invention is directed to a transgenic solanaceous plant including the transgenic solanaceous plant cell, a commodity product produced from the transgenic solanaceous plant, and transgenic progeny solanaceous plant seed or transgenic propagatable part of the transgenic solanaceous plant. Embodiments include a transgenic tomato plant, a transgenic tomato rootstock, a transgenic eggplant, or a transgenic potato plant having improved resistance to a *Leptinotarsa* species infestation. Also contemplated is a commodity product produced by the transgenic solanaceous plant, and a commodity product produced from the transgenic progeny seed of such a transgenic solanaceous plant.

Insecticidal Compositions for Controlling *Leptinotarsa* Species

Another aspect of this invention provides an insecticidal composition for controlling a *Leptinotarsa* species, wherein the insecticidal composition consists essentially of an RNA molecule that causes mortality or stunting of growth in a *Leptinotarsa* species when ingested or contacted by the *Leptinotarsa* species, and wherein the RNA molecule comprises at least one segment of 18 or more contiguous nucleotides that is essentially complementary to a fragment of a DNA having a sequence selected from the Target Gene Sequences Group, or the DNA complement thereof. In this context "controlling" a *Leptinotarsa* species comprises inducement of a physiological or behavioural change in a *Leptinotarsa* species (adult or larvae) such as, but not limited to, growth stunting or increased mortality. In some embodiments, "controlling" a *Leptinotarsa* species is achieved by a decrease in reproductive capacity, decrease in or cessation of feeding behavior or movement, or decrease in or cessation of metamorphosis stage development in a *Leptinotarsa* species. Generally the RNA molecule has been isolated, that is, substantially purified from a mixture such as from a fermentation or from an in vitro synthesis mixture. In one embodiment the RNA molecule comprises at least one segment of 18 or more contiguous nucleotides with a sequence of about 95% to about 100% complementarity to a fragment of equivalent length of a DNA having a sequence selected from the Target Gene Sequences Group or the DNA complement thereof. In some embodiments the RNA molecule comprises at least one segment of 18 or more contiguous nucleotides that is essentially complementary to a fragment of a DNA having a sequence selected from the group consisting of: SEQ ID NOs:831-1085, 1095-1104, and 1110-1114, or the complement thereof, or wherein the RNA molecule is encoded by a sequence selected from the group consisting of SEQ ID NOs:1105-1109. In some embodiments the RNA molecule is double-stranded, and the at least one segment is between about 50 to about 500 base-pairs in length. In some embodiments the RNA molecule is a dsRNA with a strand having a sequence selected from the group consisting of the Trigger Sequences Group. In some embodiments, an insecticidal composition is provided for controlling a *Leptinotarsa* species, wherein the insecticidal composition comprises a double-stranded RNA, wherein at least one strand of the double-stranded RNA is complementary to at least 21 contiguous nucleotides of a gene that encodes a ribosomal protein or an RNA transcribed from the gene, wherein the *Leptinotarsa* species is *Leptinotarsa decemlineata*, and wherein RNA interference is induced and *Leptinotarsa decemlineata* mortality occurs, and wherein the ribosomal protein is a ribosomal L7 protein or a protein encoded by SEQ ID NO:730 or wherein the double-stranded RNA comprises a sequence selected from the group consisting of SEQ ID NO:989, 988, 1104, or 1105.

Embodiments of the RNA molecule include those wherein the segment of 18 or more contiguous nucleotides has a sequence with about 95%, about 96%, about 97%, about 98%, about 99%, or about 100% complementarity to a fragment of a DNA having a sequence selected from the Target Gene Sequences Group or the DNA complement thereof. In some embodiments the contiguous nucleotides are exactly (100%) complementary to a fragment of equivalent length of a DNA having a sequence selected from the Target Gene Sequences Group or the DNA complement thereof. In some embodiments, the RNA molecule has an overall sequence of about 95%, about 96%, about 97%, about 98%, about 99%, or about 100% complementarity with a DNA having a sequence selected from the Target Gene Sequences Group or the DNA complement thereof.

Embodiments of the RNA molecule include at least one segment of 18 or more contiguous nucleotides designed to suppress expression of a target gene having a sequence selected from the Target Gene Sequences Group or the DNA complement thereof. The contiguous nucleotides of the segment number at least 18, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the RNA molecule comprises at least one segment of at least 21 contiguous nucleotides with a sequence of 100% identity with a fragment of equivalent length of a DNA or target gene having a sequence selected from the Target Gene Sequences Group or the DNA complement thereof. In particular embodiments, the RNA is a double-stranded nucleic acid (e.g., dsRNA) with one strand comprising at least one segment of at least 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 21 contiguous, perfectly matched base-pairs which correspond to a fragment of equivalent length of a DNA or target gene having a sequence selected from the Target Gene Sequences Group or the DNA complement thereof. In particular embodiments, each segment contained in the RNA molecule is of a length greater than that which is typical of naturally occurring regulatory small RNAs. In some embodiments, each segment is at least about 30 contiguous nucleotides (or base-pairs) in length. In some embodiments, the total length of the RNA molecule, or the length of each segment contained in the RNA molecule, is less than the total length of the sequence of interest (DNA or target gene having a sequence selected from the group consisting of the Target Gene Sequences Group). In some embodiments, the total length of the RNA molecule is between about 50 to about 500 nucleotides (for single-stranded polynucleotides) or base-pairs (for double-stranded polynucleotides). In some embodiments, the RNA molecule is a dsRNA of between about 100 to about 500 base-pairs, such as a dsRNA of the length of any of the dsRNA triggers disclosed in Tables 3, 5, 8, 9, and 10. In some embodiments, the insecticidal composition consists essentially of an insecticidally effective amount of a double-stranded RNA molecule with one strand having a sequence selected from the group consisting of: SEQ ID NOs:831-1085, 1095-1104, and 1110-1114, or the complement thereof, or consists essentially an insecticidally effective amount of an RNA hairpin encoded by a sequence selected from the group consisting of SEQ ID NOs:1105-1109. In some embodiments, the insecticidal composition consists essentially of an insecticidally effective amount of a double-stranded RNA molecule with one strand having a sequence selected from the group consisting of the Trigger Sequences Group.

The RNA molecule is generally designed to suppress one or more genes ("target genes"). Such target genes can include coding or non-coding sequence or both. In specific embodiments, the RNA molecule is designed to suppress one or more target genes, where each target gene has a DNA sequence selected from the group consisting of the Target Gene Sequences Group. In various embodiments, the RNA molecule is designed to suppress one or more genes, where each gene has a sequence selected from the group consisting of the Target Gene Sequences Group, and can be designed to suppress multiple genes from this group, or to target different regions of one or more of these genes. Embodiments of the RNA molecule include at least one segment of 18 or more contiguous nucleotides having a sequence designed to suppress one or more genes, where each gene has a sequence selected from the group consisting of the Target Gene Sequences Group. In an embodiment, the RNA molecule comprises multiple sections or segments each of which comprises at least one segment of 21 contiguous nucleotides with a sequence of 100% complementarity to a fragment of equivalent length of a DNA having a sequence selected from the Target Gene Sequences Group or the DNA complement thereof. In such cases, each section can be identical or different in size or in sequence. For example, in one embodiment the RNA molecule comprises multiple sections in tandem or repetitive arrangements, wherein each section comprises at least one segment of 21 contiguous nucleotides with a sequence of 100% complementarity to a fragment of equivalent length of a DNA having a sequence selected from the Target Gene Sequences Group or the DNA complement thereof; the segments can be from different regions of the target gene, e.g., the segments can correspond to different exon regions of the target gene, and "spacer" nucleotides which do not correspond to a target gene can optionally be used in between or adjacent to the segments.

The RNA molecule can have a total length that is greater than 18 contiguous nucleotides, and can include nucleotides in addition to the segment of at least one segment of 18 or more contiguous nucleotides having the sequence of about 95% to about 100% complementarity to a fragment of equivalent length of a DNA having a sequence selected from the Target Gene Sequences Group or the DNA complement thereof. In other words, the total length of the RNA molecule can be greater than the length of the segment which is designed to suppress one or more target genes, where each target gene has a DNA sequence selected from the group consisting of the Target Gene Sequences Group. For example, the RNA molecule can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the RNA molecule comprises additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the RNA molecule comprises additional nucleotides located immediately adjacent to one or more segment of 18 or more contiguous nucleotides with a sequence of about 95% to about 100% complementarity to a fragment of equivalent length of a DNA or target gene having a sequence selected from the group consisting of the Target Gene Sequences Group. In an embodiment, the RNA molecule comprises one such segment, with an additional 5' G or an additional 3' C or both, adjacent to the segment. In another embodiment, the RNA molecule is a double-stranded RNA comprising additional nucleotides to form an overhang, for example, a dsRNA comprising 2 deoxyribonucleotides to form a 3' overhang. Thus in various embodiments, the nucleotide sequence of the entire RNA molecule is not 100% identical or complementary to a fragment of contiguous nucleotides in the DNA or target gene having a sequence selected from the group consisting of the Target Gene Sequences Group. For example, in some embodiments the RNA molecule comprises at least two segments of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

The RNA molecule can be single-stranded (ss) or double-stranded (ds) or a combination of both. Embodiments of the RNA molecule include sense single-stranded RNA (ssRNA), anti-sense ssRNA, or double-stranded RNA (dsRNA), or a combination of any of these. The RNA can include components other than standard ribonucleotides, e.g., an embodiment is an RNA that comprises terminal deoxyribonucleotides. In various embodiments the RNA molecule consists of naturally occurring ribonucleotides. In certain embodiments, the RNA molecule is a combination of ribonucleotides and deoxyribonucleotides, for example, synthetic RNA molecule consisting mainly of ribonucleotides but with one or more terminal deoxyribonucleotides or one or more terminal. In certain embodiments, the RNA molecule comprises non-canonical nucleotides such as inosine, thio-uridine, or pseudouridine. In certain embodiments, the RNA molecule comprises chemically modified nucleotides.

The RNA molecule is provided by suitable means known to one in the art. Embodiments include those wherein the RNA molecule is synthesized in vitro, produced by expression in a microorganism or in cell culture (such as plant or insect cells grown in culture), produced by expression in a plant cell, or produced by microbial fermentation.

In some embodiments the RNA molecule comprises other RNA elements, such as RNA aptamers or ribozymes, additional non-coding RNA (e.g., additional suppression elements), or one or more recognition sites for binding and cleavage by a small RNA (e.g., by a miRNA or an siRNA that is expressed only in a particular cell or tissue).

The insecticidal composition can be provided for topical application to a surface of a plant or of a plant seed, or for topical application to any substrate needing protection from a *Leptinotarsa* species infestation. Likewise, the insecticidal composition can be provided for topical application to a *Leptinotarsa* species, or in a composition for ingestion by a *Leptinotarsa* species. In various embodiments, the insecticidal composition is provided in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Suitable binders, inert carriers, surfactants, and the like can included in the insecticidal composition, as is known to one skilled in formulation of pesticides and seed treatments. While the insecticidal composition consists essentially of an RNA molecule, in some embodiments the insecticidal composition further comprises at least one non-insecticidal agent selected from the group consisting of a carrier agent, a salt, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, and a safener. In one embodiment the composition containing the recombinant RNA molecule further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. Furthermore, the insecticidal composition can be used in combination with, subsequently to, or preceding, treatment with a polynucleotide herbicidal molecule, a non-polynucleotide herbicidal molecule, a non-polynucleotide pesticide (e.g., at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein). Related compositions include combinations of the RNA molecule with a polynucleotide herbicidal molecule, a non-polynucleotide herbicidal molecule, a non-polynucleotide pesticide.

The insecticidal composition can be provided for dietary uptake by a *Leptinotarsa* species by applying the composition to a plant or surface subject to infestation by the *Leptinotarsa* species, for example by spraying, dusting, or coating the plant, or by application of a soil drench, or by providing in an artificial diet. The insecticidal composition can be provided for dietary uptake by a *Leptinotarsa* species in an artificial diet formulated to meet the particular nutritional requirements for maintaining the *Leptinotarsa* species, wherein the artificial diet is supplemented with some amount of the recombinant RNA molecule obtained from a separate source such as in vitro synthesis or purified from a microbial fermentation or other biological source; this embodiment can be useful, e.g., for determining the timing and amounts of effective treatment regimes. The insecticidal composition can be provided for dietary uptake by the *Leptinotarsa* species in the form of a seed treatment.

Methods of Providing Plants Having Improved Resistance to *Leptinotarsa* Species Infestations, and the Plants, Plant Parts, and Seeds Thus Provided Several embodiments relate to a method of providing a plant having improved resistance to a *Leptinotarsa* species infestation comprising providing to the plant at least one polynucleotide comprising at least one segment of 18 or more contiguous nucleotides that is essentially identical or complementary to a fragment of a target gene selected from the group consisting of the genes identified in the Target Gene Sequences Group. In an embodiment, this invention provides a method of providing a plant having improved resistance to a *Leptinotarsa* species infestation comprising providing to the plant at least one polynucleotide comprising at least one segment that is identical or complementary to at least 21 contiguous nucleotides of a target gene or an RNA transcribed from the target gene, wherein the target gene is selected from the genes identified in the Target Gene Sequences Group or an RNA transcribed from the target gene. Embodiments of these target genes are identified by name in Tables 1, 2 and 4 and include genes having a sequence selected from the group consisting of the Target Gene Sequences Group, as well as related genes, including orthologues from related insect species, for example related genes from other *Leptinotarsa* species, *Tribolium* species, or other related genera. Examples of such related target genes include the *Tribolium castaneum* genes listed in Table 1. In some embodiments, the polynucleotide is a double-stranded RNA. In some embodiments, the polynucleotide (e.g., double-stranded RNA) is chemically synthesized or is produced by expression in a microorganism or by expression in a plant cell. In some embodiments the polynucleotide comprises at least one segment of 18 or more contiguous nucleotides that is essentially identical or complementary to a sequence selected from the group consisting of the Target Gene Sequences Group. In some embodiments the polynucleotide is a dsRNA with a strand having a sequence selected from the group consisting of: SEQ ID NOs:831-1085, 1095-1104, and 1110-1114, or the complement thereof, or wherein the polynucleotide is encoded by a sequence selected from the group consisting of SEQ ID NOs:1105-1109. In some embodiments the polynucleotide comprises a dsRNA with a strand having a sequence selected from the Trigger Sequences Group.

In one embodiment the method comprises topically applying to the plant a composition comprising at least one polynucleotide comprising at least one segment of 18 or more contiguous nucleotides that are essentially identical or complementary to a fragment of equivalent length of a DNA of a target gene selected from the group consisting of the genes identified in the Target Gene Sequences Group, whereby the plant treated with the polynucleotide composition exhibits improved resistance to a *Leptinotarsa* species infestation, relative to an untreated plant. By "topical application" is meant application to the surface or exterior of an object, such as the surface or exterior of a plant, such as application to the surfaces of a plant part such as a leaf, stem, flower, fruit, shoot, root, seed, tuber, flowers, anthers, or pollen, or application to an entire plant, or to the above-ground or below-ground portions of a plant. Topical application can be carried out on non-living surfaces, such as application to soil, or to a surface or matrix by which a *Leptinotarsa* insect can come in contact with the polynucleotide. In various embodiments of the method, the polynucleotide-containing composition is topically applied to the plant in a suitable form, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. In some embodiments of the method, the polynucleotide-containing composition is topically applied to above-ground parts of the plant, e.g., sprayed or dusted onto leaves, stems, and flowering parts of the plant. Embodiments of the method include topical application of a foliar spray (e.g., spraying a liquid polynucleotide-containing composition on leaves of a solanaceous plant) or a foliar dust (e.g., dusting a solanaceous plant with a polynucleotide-containing composition in the form of a powder or on carrier particulates). In other embodiments, the polynucleotide-containing composition is topically applied to below-ground parts of the plant, such as to the roots, e.g., by means of a soil drench. In other embodiments, the polynucleotide-containing composition is topically applied to a seed that is grown into the plant. The topical application can be in the form of topical treatment of fruits of solanaceous plants or seeds from fruits of solanaceous plants, or in the form of topical treatment of "seed potato" tubers or pieces of tuber (e.g., by soaking, coating, or dusting the seed potato). Suitable binders, inert carriers, surfactants, and the like can optionally be included in the polynucleotide-containing composition, as is known to one skilled in formulation of pesticides and seed treatments. In some embodiments, the polynucleotide-containing composition is at least one topically implantable formulation selected from the group consisting of a particulate, pellet, or capsule topically implanted in the plant; in such embodiments the method comprises topically implanting in the plant the topically implantable formulation. In some embodiments, the polynucleotide-containing composition is at least one in-furrow formulation selected from the group consisting of a powder, granule, pellet, capsule, spray, or drench, or any other forms suited for topically applying to a furrow; in such embodiments, the method includes an in-furrow treatment with the in-furrow formulation. In one embodiment the polynucleotide-containing composition can be ingested or otherwise absorbed internally by the *Leptinotarsa* species. For example, the polynucleotide-containing composition can be in the form of bait. In some embodiments, the polynucleotide-containing composition further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In one embodiment the composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. In some embodiments, the topically applied composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Alternatively such additional components or pesticidal agents can be provided separately, e.g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants, e.g., SILWET L-77® brand surfactant, followed by a second topical application of the polynucleotide-containing composition, or vice-versa.

It is anticipated that the combination of certain polynucleotides (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, a composition containing one or more polynucleotides and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to effect synergistically improved prevention or control of *Leptinotarsa* species infestations when topically applied to a plant.

In some embodiments, the method comprises topically applying to the plant a composition comprising at least one polynucleotide comprising at least one segment of 18 or more contiguous nucleotides that are essentially identical or complementary to a fragment of equivalent length of a DNA of a target gene selected from the group consisting of the genes identified in the Target Gene Sequences Group. The polynucleotide topically applied to the plant can be single-stranded (ss) or double-stranded (ds).

The polynucleotide topically applied to the plant is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide topically applied to the plant is provided as an isolated DNA or RNA. In some embodiments, the polynucleotide topically applied to the plant is not part of an expression construct and is lacking additional elements such as a promoter or terminator sequences. Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Alternatively the polynucleotide can be provided in more complex constructs, e.g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e.g., an insecticidal protein).

The polynucleotide topically applied to the plant has at least one segment of 18 or more contiguous nucleotides that are essentially identical or complementary to a fragment of equivalent length of a DNA of a target gene selected from the group consisting of the genes identified in the Target Gene Sequences Group, or that have a sequence of about 95% to about 100% identity with or complementarity to a fragment of equivalent length of a DNA of a target gene selected from the group consisting of the genes identified in the Target Gene Sequences Group. In an embodiment the polynucleotide topically applied to the plant comprises at least one segment of 18 or more contiguous nucleotides that are essentially identical or complementary to a fragment of equivalent length of a DNA of a target gene selected from the group consisting of the genes identified in the Target Gene Sequences Group. In some embodiments, the contiguous nucleotides have a sequence of about 95%, about 96%, about 97%, about 98%, about 99%, or about 100% identity with or complementarity to the fragment of equivalent length of a DNA of a target gene selected from the group consisting of the genes identified in the Target Gene Sequences Group. In some embodiments the contiguous nucleotides are exactly (100%) identical or complementary to a fragment of equivalent length of a DNA of a target gene selected from the group consisting of the genes identified in the Target Gene Sequences Group. In some embodiments, the polynucleotide has an overall sequence of about 95%, about 96%, about 97%, about 98%, about 99%, or about 100% identity or complementarity with a fragment of a DNA of a target gene selected from the group consisting of the genes identified in the Target Gene Sequences Group.

The polynucleotide topically applied to the plant is generally designed to suppress one or more genes ("target genes"). In specific embodiments, the polynucleotide is designed to suppress one or more target genes selected from the group consisting of the genes identified in the Target Gene Sequences Group. Embodiments of the genes identified in the Target Gene Sequences Group include, but are not limited to, the cDNA sequences selected from the group consisting of the Target Gene Sequences Group. In various embodiments, the polynucleotide topically applied to the plant is designed to suppress one or more genes, where each gene is selected from the group consisting of the genes identified in the Target Gene Sequences Group, and can be designed to suppress multiple genes from this group, or to target different regions of one or more of these genes. In an embodiment, the polynucleotide topically applied to the plant comprises multiple sections or segments each of which comprises at least one segment of 18 or more contiguous nucleotides with a sequence of about 95% to about 100% identity or complementarity with a fragment of equivalent length of a DNA of a target gene selected from the group consisting of the genes identified in the Target Gene Sequences Group. In such cases, each section can be identical or different in size or in sequence, and can be sense or anti-sense relative to the target gene. For example, in one embodiment the polynucleotide topically applied to the plant can include multiple sections in tandem or repetitive arrangements, wherein each section comprises at least one segment of 21 contiguous nucleotides with a sequence of 100% identity or 100% complementarity with a fragment of equivalent length of a DNA of a target gene selected from the group consisting of the genes identified in the Target Gene Sequences Group; the segments can be from different regions of the target gene, e.g., the segments can correspond to different exon regions of a cDNA with a sequence selected from the group consisting of the Target Gene Sequences Group, and "spacer" nucleotides which do not correspond to a target gene can optionally be used in between or adjacent to the segments.

The total length of the polynucleotide topically applied to the plant can be greater than 18 contiguous nucleotides, and can include nucleotides in addition to the at least one segment of contiguous nucleotides having the sequence essentially identical or complementary to a fragment of equivalent length of a DNA of a target gene selected from the group consisting of the genes identified in the Target Gene Sequences Group. In other words, the total length of the polynucleotide topically applied to the plant can be greater than the length of the section or segment of the polynucleotide designed to suppress one or more target genes, where each target gene is selected from the group consisting of the genes identified in the Target Gene Sequences Group. For example, the polynucleotide topically applied to the plant can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide topically applied to the plant comprises additional nucleotides that are not specifically related (having a sequence not complementary or identical to) to the target gene is selected from the group consisting of the genes identified in the Target Gene Sequences Group, e.g., nucleotides that provide stabilizing secondary structure or for convenience in cloning or manufacturing. In an embodiment, the polynucleotide topically applied to the plant comprises additional nucleotides located immediately adjacent to one or more segment of 18 or more contiguous nucleotides with a sequence of about 95% to about 100% identity with or complementarity to the target gene selected from the group consisting of the genes identified in the Target Gene Sequences Group. In an embodiment, the polynucleotide topically applied to the plant comprises one such segment, with an additional 5' G or an additional 3' C or both, adjacent to the segment. In another embodiment, the polynucleotide topically applied to the plant is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide topically applied to the plant is not 100% identical or complementary to a fragment of contiguous nucleotides in the target gene selected from the group consisting of the genes identified in the Target Gene Sequences Group. For example, in some embodiments the polynucleotide topically applied to the plant comprises at least two segments each of 21 contiguous nucleotides with a sequence of 100% identity with a fragment of a target gene selected from the group consisting of the genes identified in the Target Gene Sequences Group, wherein (1) the at least two segments are separated by one or more spacer nucleotides, or (2) the at least two segments are arranged in an order different from that in which the corresponding fragments occur in the target gene selected from the group consisting of the genes identified in the Target Gene Sequences Group.

In a related aspect, this invention is directed to the plant having improved resistance to a *Leptinotarsa* species infestation, provided by this method which comprises topically applying to the plant a composition comprising at least one polynucleotide comprising at least one segment of 18 or more contiguous nucleotides that are essentially identical or complementary to a fragment of equivalent length of a DNA of a target gene selected from the group consisting of the genes identified in the Target Gene Sequences Group, whereby the plant treated with the polynucleotide composition exhibits improved resistance to a *Leptinotarsa* species infestation, relative to an untreated plant. In yet another aspect, this invention is directed to seed (especially transgenic progeny seed) produced by the plant having improved resistance to a *Leptinotarsa* species infestation, as provided by this method. Also contemplated is a commodity product produced by the plant having improved resistance to a *Leptinotarsa* species infestation, as provided by this method, and a commodity product produced from the transgenic progeny seed of such a plant.

In another embodiment the method comprises expressing in the plant at least one polynucleotide comprising at least one segment of 18 or more contiguous nucleotides that are essentially identical or complementary to a fragment of equivalent length of a target gene selected from the group consisting of the genes identified in the Target Gene Sequences Group, whereby the plant expressing the polynucleotide exhibits improved resistance to a *Leptinotarsa* species infestation, relative to an plant not expressing the polynucleotide. In an embodiment the method comprises expressing in the plant at least one polynucleotide comprising at least one segment of 18 or more contiguous nucleotides with a sequence of about 95% to about 100% identity or complementarity with a fragment of equivalent length of a DNA of a target gene selected from the group consisting of the genes identified in the Target Gene Sequences Group. Embodiments of these target genes are identified by name in Tables 1, 2 and 4 and include genes having a sequence selected from the group consisting of the Target Gene Sequences Group, as well as related genes, including orthologues from related insect species, for example related genes from other *Leptinotarsa* species, *Tribolium* species, or other related genera. Examples of such related target genes include the *Tribolium castaneum* genes listed in Table 1. By "expressing a polynucleotide in the plant" is generally meant "expressing an RNA transcript in the plant". However, the polynucleotide expressed in the plant can also be DNA, e.g., a DNA produced in the plant during genome replication.

The method comprises expressing at least one polynucleotide in a plant, wherein the polynucleotide comprises at least one segment of 18 or more contiguous nucleotides that is essentially identical or complementary to a fragment of a target gene selected from the group consisting of the genes identified in the Target Gene Sequences Group. In some embodiments, a first polynucleotide is provided to a plant in the form of DNA (e.g., in the form of an isolated DNA molecule, or as an expression construct, or as a transformation vector), and the polynucleotide expressed in the plant is a second polynucleotide (e.g., the RNA transcript of the first polynucleotide) in the plant. In an embodiment, the polynucleotide is expressed in the plant by transgenic expression, i.e., by stably integrating the polynucleotide into the plant's genome from where it can be expressed in a cell or cells of the plant. In an embodiment, a first polynucleotide (e.g., a recombinant DNA construct comprising a promoter operably linked to DNA comprising at least one segment of 18 or more contiguous nucleotides that is essentially identical or complementary to a fragment of target gene selected from the group consisting of the genes identified in the Target Gene Sequences Group is stably integrated into the plant's genome from where secondarily produced polynucleotides (e.g., an RNA transcript comprising the transcript of the segment of 18 or more contiguous nucleotides that is essentially identical or complementary to a fragment of target gene selected from the group consisting of the genes identified in the Target Gene Sequences Group) are expressed in a cell or cells of the plant. Methods of providing stably transformed plants are provided in the section headed "Making and Using Transgenic Plant Cells and Transgenic Plants".

In another embodiment the polynucleotide expressed in the plant is expressed by transient expression (i.e., expression not resulting from stable integration of a sequence into the plant's genome). In such embodiments the method can include a step of introducing a polynucleotide (e.g., dsRNA or dsDNA) into the plant by routine techniques known in the art. For example, transient expression can be accomplished by infiltration of a polynucleotide solution using a needleless syringe into a leaf of a plant.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant. In some embodiments, the first polynucleotide is one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In specific embodiments, a first polynucleotide is introduced into the plant by topical application to the plant of a polynucleotide-containing composition in a suitable form, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or in the form of a treatment of a solanaceous plant seed or treatment of a seed potato. Suitable binders, inert carriers, surfactants, and the like can optionally be included in the composition, as is known to one skilled in formulation of pesticides and seed treatments. In such embodiments, the polynucleotide-containing composition can further include one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator; in one embodiment the composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. In some embodiments, the topically applied composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Alternatively such additional components or pesticidal agents can be provided separately, e.g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants, e.g., SILWET L-77® brand surfactant, followed by a second topical application of the polynucleotide-containing composition, or vice-versa.

It is anticipated that the combination of certain polynucleotides of use in this method (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, a transgenic plant expressing at least one polynucleotide comprising at least one segment of 18 or more contiguous nucleotides that is essentially identical or complementary to a fragment of target gene selected from the group consisting of the genes identified in Table 1 (e.g., the polynucleotide triggers described in the working Examples) and one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to exhibit synergistically improved resistance to *Leptinotarsa* species infestations.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant; the site of application of the first polynucleotide need not be the same site where the second polynucleotide is transiently expressed. For example, a first polynucleotide can be provided to a plant by topical application onto a leaf, or by injection into a stem, and the second polynucleotide can be transiently expressed elsewhere in the plant, e.g., in the roots or throughout the plant. In some embodiments of the method, a composition comprising at least one polynucleotide is topically applied to above-ground parts of the plant, e.g., sprayed or dusted onto leaves, stems, and flowering parts of the plant. In other embodiments, a composition comprising at least one polynucleotide is topically applied to below-ground parts of the plant, such as to the roots, e.g., by means of a soil drench. In other embodiments, a composition comprising at least one polynucleotide is topically applied to a seed (or, in the case of potatoes, topically applied to a seed potato) that is grown into the plant having improved resistance to a *Leptinotarsa* species infestation.

In some embodiments the polynucleotide expressed in the plant is RNA, which can be single-stranded (ss) or double-stranded (ds) RNA or a combination of both.

In some embodiments a first polynucleotide (DNA or RNA or both) is provided to a plant and a second polynucleotide having a sequence corresponding (identical or complementary) to the first polynucleotide is subsequently expressed in the plant. In such embodiments the polynucleotide expressed in the plant is an RNA transcript which can be ssRNA or dsRNA or a combination of both. In some embodiments where the polynucleotide is expressed by transient expression, a first polynucleotide is provided to a plant in the form of RNA or DNA or both RNA and DNA, and a secondarily produced second polynucleotide is transiently expressed in the plant; in such embodiments, the first polynucleotide one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In such embodiments where the polynucleotide is expressed by transient expression the first polynucleotide can consist of naturally occurring nucleotides, such as those which occur in DNA and RNA. In such embodiments where the polynucleotide is expressed by transient expression the first polynucleotide can be chemically modified, or comprises chemically modified nucleotides. The first polynucleotide is provided by suitable means known to one in the art. Embodiments include those wherein the first polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation. The first polynucleotide can be provided as an RNA or DNA fragment. Alternatively the first polynucleotide can be provided in more complex constructs, e.g., as part of a recombinant expression construct, or included in a recombinant vector, for example in a recombinant plant virus vector or in a recombinant baculovirus vector; such recombinant expression constructs or vectors can be designed to include additional elements, such as expression cassettes for expressing a gene of interest (e.g., an insecticidal protein).

In some embodiments the polynucleotide expressed in the plant is an RNA molecule and can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., an insecticidal protein).

The polynucleotide expressed in the plant has at least one segment of 18 or more contiguous nucleotides with a sequence of about 95% to about 100% identity with or complementarity to a fragment of equivalent length of a target gene selected from the group consisting of the genes identified in the Target Gene Sequences Group. In an embodiment the polynucleotide expressed in the plant comprises at least one segment of 18 or more contiguous nucleotides that are essentially identical or complementary to a fragment of equivalent length of a target gene selected from the group consisting of the genes identified in the Target Gene Sequences Group. In some embodiments, the contiguous nucleotides have a sequence of about 95%, about 96%, about 97%, about 98%, about 99%, or about 100% identity with or complementarity to a fragment of equivalent length of a target gene selected from the group consisting of the genes identified in the Target Gene Sequences Group. In some embodiments the contiguous nucleotides are exactly (100%) identical or complementary to a fragment of equivalent length of a target gene selected from the group consisting of the genes identified in the Target Gene Sequences Group. In some embodiments, the polynucleotide expressed in the plant has an overall sequence of about 95%, about 96%, about 97%, about 98%, about 99%, or about 100% identity with or complementarity to a fragment of a target gene selected from the group consisting of the genes identified in the Target Gene Sequences Group.

The polynucleotide expressed in the plant is generally designed to suppress one or more genes ("target genes"). Such target genes can include coding or non-coding sequence or both. In specific embodiments, the polynucleotide expressed in the plant is designed to suppress one or more target genes selected from the group consisting of the genes identified in the Target Gene Sequences Group. In various embodiments, the polynucleotide expressed in the plant is designed to suppress one or more target genes selected from the group consisting of the genes identified in the Target Gene Sequences Group, and can be designed to suppress multiple genes from this group, or to target different regions of one or more of these genes. In an embodiment, the polynucleotide expressed in the plant comprises multiple sections or segments each of which comprises at least one segment of 18 or more contiguous nucleotides with a sequence of about 95% to about 100% identity with or complementarity to a fragment of a target gene selected from the group consisting of the genes identified in the Target Gene Sequences Group. In such cases, each section can be identical or different in size or in sequence, and can be sense or anti-sense relative to the target gene. For example, in one embodiment the polynucleotide expressed in the plant can include multiple sections in tandem or repetitive arrangements, wherein each section comprises at least one segment of 18 or more contiguous nucleotides with a sequence of about 95% to about 100% identity with or complementarity to a fragment of a target gene selected from the group consisting of the genes identified in the Target Gene Sequences Group; the segments can be from different regions of the target gene, e.g., the segments can correspond to different exon regions of the target gene, and "spacer" nucleotides which do not correspond to a target gene can optionally be used in between or adjacent to the segments.

The total length of the polynucleotide expressed in the plant can be greater than 18 contiguous nucleotides, and can include nucleotides in addition to the contiguous nucleotides having the sequence of about 95% to about 100% identity with or complementarity to a fragment of a target gene selected from the group consisting of the genes identified in the Target Gene Sequences Group. In other words, the total length of the polynucleotide expressed in the plant can be greater than the length of the section or segment of the polynucleotide designed to suppress one or more target genes selected from the group consisting of the genes identified in the Target Gene Sequences Group. For example, the polynucleotide expressed in the plant can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide expressed in the plant comprises additional nucleotides that are not specifically related (having a sequence not complementary or identical to) to the target gene selected from the group consisting of the genes identified in the Target Gene Sequences Group, e.g., nucleotides that provide stabilizing secondary structure or for convenience in cloning or manufacturing. In an embodiment, the polynucleotide expressed in the plant comprises additional nucleotides located immediately adjacent to one or more segment of 18 or more contiguous nucleotides with a sequence of about 95% to about 100% identity with or complementarity to a fragment of equivalent length of a target gene selected from the group consisting of the genes identified in the Target Gene Sequences Group. In an embodiment, the polynucleotide expressed in the plant comprises one such segment, with an additional 5' G or an additional 3' C or both, adjacent to the segment. In another embodiment, the polynucleotide expressed in the plant is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide expressed in the plant is not 100% identical or complementary to a fragment of contiguous nucleotides in the target gene selected from the group consisting of the genes identified in the Target Gene Sequences Group. For example, in some embodiments the polynucleotide expressed in the plant comprises at least two segments of 21 contiguous nucleotides with a sequence of 100% identity with or 100% complementarity to a fragment of a target gene selected from the group consisting of the genes identified in the Target Gene Sequences Group, wherein (1) the at least two segments are separated by one or more spacer nucleotides, or (2) the at least two segments are arranged in an order different from that in which the corresponding fragments occur in the target gene selected from the group consisting of the genes identified in the Target Gene Sequences Group.

In a related aspect, this invention is directed to the plant having improved resistance to a *Leptinotarsa* species infestation, provided by expressing in the plant at least one polynucleotide comprising at least one segment of 18 or more contiguous nucleotides that are essentially identical or complementary to a fragment of equivalent length of a target gene selected from the group consisting of the genes identified in the Target Gene Sequences Group, whereby the resulting plant has improved resistance to a *Leptinotarsa* species infestation when compared to a control plant in which the polynucleotide is not expressed. In a related aspect, this invention is directed to the plant having improved resistance to a *Leptinotarsa* species infestation, provided by expressing in the plant at least one polynucleotide comprising at least one segment of 18 or more contiguous nucleotides with a sequence of about 95% to about 100% identity with or complementarity to a fragment of a target gene selected from the group consisting of the genes identified in the Target Gene Sequences Group, whereby the resulting plant has improved resistance to a *Leptinotarsa* species infestation when compared to a control plant in which the polynucleotide is not expressed. An embodiment is a solanaceous plant having improved resistance to a *Leptinotarsa* species infestation when compared to a control plant, provided by expressing in the plant an RNA having a sequence selected from the group consisting of SEQ ID NOs:831-1085 and 1095. In yet another aspect, this invention is directed to seed or propagatable parts (especially transgenic progeny seed or propagatable parts) produced by the plant having improved resistance to a *Leptinotarsa* species infestation, as provided by this method. Also contemplated is a commodity product produced by the plant having improved resistance to a *Leptinotarsa* species infestation, as provided by this method, and a commodity product produced from the transgenic progeny seed or propagatable parts of such a plant.

Methods of Controlling *Leptinotarsa* Species Infestations of a Plant

Several embodiments relate to a method for controlling a *Leptinotarsa* species infestation of a plant comprising contacting the *Leptinotarsa* species with a polynucleotide comprising at least one segment of 18 or more contiguous nucleotides that is essentially identical or complementary to a fragment of equivalent length of a DNA of a target gene selected from the group consisting of the genes identified in the Target Gene Sequences Group. In this context "controlling" includes inducement of a physiological or behavioural change in a *Leptinotarsa* species (adult or larvae) such as, but not limited to, growth stunting, increased mortality, decrease in reproductive capacity, decrease in or cessation of feeding behavior or movement, or decrease in or cessation of metamorphosis stage development. In an embodiment, the method for controlling a *Leptinotarsa* species infestation of a plant comprises contacting the *Leptinotarsa* species with a polynucleotide comprising at least one segment that is identical or complementary to at least 21 contiguous nucleotides of a target gene selected from the genes identified in the Target Gene Sequences Group or an RNA transcribed from the target gene. In some embodiments, the polynucleotide is a double-stranded RNA. In some embodiments, the polynucleotide (e.g., double-stranded RNA) is chemically synthesized or is produced by expression in a microorganism or by expression in a plant cell. In some embodiments, the polynucleotide is a double-stranded RNA comprising a strand comprising a sequence selected from the Trigger Sequences Group. In an embodiment, the method for controlling a *Leptinotarsa* species infestation of a plant comprises contacting the *Leptinotarsa* species with an effective amount of a double-stranded RNA, one strand of which is complementary to at least 21 contiguous nucleotides of a gene that encodes a ribosomal protein, wherein RNA interference is induced and mortality occurs. Embodiments of target genes are identified by name in Tables 1, 2 and 4 and include genes having a sequence selected from the group consisting of the Target Gene Sequences Group, as well as related genes including orthologues from related insect species, for example, related genes from other *Leptinotarsa* species, *Tribolium* species, or other related coleopteran genera. Examples of such related genes include the *Tribolium castaneum* genes listed in Table 1. In some embodiments the polynucleotide comprises at least one segment of 18 or more contiguous nucleotides that is essentially identical or complementary to a fragment of a target gene having a sequence selected from the group consisting of the Target Gene Sequences Group. In some embodiments the polynucleotide comprises RNA having a sequence selected from the group consisting of SEQ ID NOs:831-1085, 1095-1104, and 1110-1114, or the complement thereof, or is an RNA hairpin encoded by a sequence selected from the group consisting of SEQ ID NOs:1105-1109. In some embodiments the polynucleotide comprises a dsRNA with a strand having a sequence selected from the group consisting of the Trigger Sequences Group. In some embodiments, this invention provides a method for controlling a *Leptinotarsa* species infestation of a plant comprising contacting the *Leptinotarsa* species with an effective amount of a solution comprising a double-stranded RNA, wherein at least one strand of the double-stranded RNA is complementary to at least 21 contiguous nucleotides of a gene that encodes a ribosomal protein or an RNA transcribed from the gene, wherein the *Leptinotarsa* species is *Leptinotarsa decemlineata*, and wherein RNA interference is induced and *Leptinotarsa decemlineata* mortality occurs, and wherein the ribosomal protein is a ribosomal L7 protein or a protein encoded by SEQ ID NO:730 or wherein the double-stranded RNA comprises a sequence selected from the group consisting of SEQ ID NO:989, 988, 1104, or 1105; in some embodiments, the solution further comprises one or more components selected from the group consisting of an organosilicone surfactant or a cationic lipid.

In some embodiments, the contiguous nucleotides have a sequence of about 95%, about 96%, about 97%, about 98%, about 99%, or about 100% identity with or complementarity to a fragment of equivalent length of a target gene selected from the group consisting of the genes identified in the Target Gene Sequences Group. In some embodiments the contiguous nucleotides are exactly (100%) identical or complementary to a fragment of equivalent length of a target gene selected from the group consisting of the genes identified in the Target Gene Sequences Group. In some embodiments, the polynucleotide has an overall sequence of about 95%, about 96%, about 97%, about 98%, about 99%, or about 100% identity with or complementarity to a fragment of equivalent length of a target gene selected from the group consisting of the genes identified in the Target Gene Sequences Group. In an embodiment, the polynucleotide comprises at least one segment of 21 contiguous nucleotides with a sequence of 100% identity or complementarity with the corresponding fragment of a target gene selected from the group consisting of the genes identified in the Target Gene Sequences Group; in some embodiments, the polynucleotide comprises "neutral" sequence (having no sequence identity or complementarity to the target gene) in addition to a segment of 21 contiguous nucleotides with 100% identity with the corresponding fragment of the target gene, and therefore the polynucleotide as a whole is of much lower overall sequence identity with a target gene.

The polynucleotide of use in this method is generally designed to suppress one or more genes ("target genes"). The term "gene" refers to any portion of a nucleic acid that provides for expression of a transcript or encodes a transcript. A "gene" can include, but is not limited to, a promoter region, 5' untranslated regions, transcript encoding regions that can include intronic regions, 3' untranslated regions, or combinations of these regions. In some embodiments, the target genes can include coding or non-coding sequence or both. In other embodiments, the target gene has a sequence identical to or complementary to a messenger RNA, e.g., in some embodiments the target gene is a cDNA. In specific embodiments, the polynucleotide is designed to suppress one or more target genes selected from the group consisting of the genes identified in the Target Gene Sequences Group. In various embodiments, the polynucleotide is designed to suppress one or more target genes selected from the group consisting of the genes identified in the Target Gene Sequences Group, and can be designed to suppress multiple target genes from this group, or to target different regions of one or more of these target genes. In an embodiment, the polynucleotide comprises multiple segments of 21 contiguous nucleotides with a sequence of 100% identity with a fragment of equivalent length of a DNA or target gene having a sequence selected from the Target Gene Sequences Group or the DNA complement thereof. In such cases, each segment can be identical or different in size or in sequence, and can be sense or anti-sense relative to the target gene. For example, in one embodiment the polynucleotide comprises multiple segments in tandem or repetitive arrangements, wherein each segment comprises 18 or more contiguous nucleotides with a sequence of about 95% to about 100% identity with or complementarity to a fragment of equivalent length of a target gene selected from the group consisting of the genes identified in the Target Gene Sequences Group; the segments can be from different regions of the target gene, e.g., the segments can correspond to different exon regions of the target gene, and "spacer" nucleotides which do not correspond to a target gene can optionally be used in between or adjacent to the segments.

The total length of the polynucleotide of use in this method can be greater than 18 contiguous nucleotides, and can include nucleotides in addition to the contiguous nucleotides having the sequence of about 95% to about 100% identity with or complementarity to a fragment of equivalent length of a target gene selected from the group consisting of the genes identified in the Target Gene Sequences Group. In other words, the total length of the polynucleotide can be greater than the length of the section or segment of the polynucleotide designed to suppress one or more target genes selected from the group consisting of the genes identified in the Target Gene Sequences Group. For example, the polynucleotide can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that are not specifically related (having a sequence not complementary or identical to) to the target gene selected from the group consisting of the genes identified in the Target Gene Sequences Group, e.g., nucleotides that provide stabilizing secondary structure or for convenience in cloning or manufacturing. In an embodiment, the polynucleotide can include additional nucleotides located immediately adjacent to one or more segment of 18 or more contiguous nucleotides with a sequence of about 95% to about 100% identity with or complementarity to a fragment of equivalent length of a target gene selected from the group consisting of the genes identified in the Target Gene Sequences Group. In an embodiment, the polynucleotide comprises one such segment, with an additional 5' G or an additional 3' C or both, adjacent to the segment. In another embodiment, the polynucleotide is a double-stranded RNA comprising additional nucleotides to form an overhang, for example, a dsRNA comprising 2 deoxyribonucleotides to form a 3' overhang. Thus in various embodiments, the nucleotide sequence of the entire polynucleotide is not 100% identical or complementary to a sequence of contiguous nucleotides in the target gene selected from the group consisting of the genes identified in the Target Gene Sequences Group. For example, in some embodiments the polynucleotide comprises at least two segments each of 21 contiguous nucleotides with a sequence of 100% identity with a fragment of equivalent length of the target gene, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

The polynucleotide of use in this method is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In some embodiments the polynucleotide of use in this method is provided as an isolated DNA or RNA fragment. In some embodiments the polynucleotide of use in this method is not part of an expression construct and is lacking additional elements such as a promoter or terminator sequences). Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Tables 3, 5, 8, 9, and 10. Embodiments include those in which the polynucleotide is a dsRNA comprising a segment having a sequence selected from the group consisting of: SEQ ID NOs:831-1085, 1095-1104, and 1110-1114, or the complement thereof, or wherein the polynucleotide is an RNA hairpin encoded by a sequence selected from the group consisting of SEQ ID NOs:1105-1109. Alternatively the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., an insecticidal protein).

In various embodiments of the method, the contacting comprises application to a surface of the *Leptinotarsa* species of a suitable composition comprising the polynucleotide of use in this method; such a composition can be provided, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a seed treatment. The contacting can be in the form of a seed treatment, or in the form of treatment of "seed potato" tubers or pieces of tuber (e.g., by soaking, coating, or dusting the seed potato). Suitable binders, inert carriers, surfactants, and the like can optionally be included in the composition, as is known to one skilled in formulation of pesticides and seed treatments. In some embodiments, the contacting comprises providing the polynucleotide in a composition that further comprises one or more components selected from the group consisting of a carrier agent, a surfactant, a cationic lipid (such as that disclosed in Example 18 of U.S. patent application publication 2011/0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In embodiments, the contacting comprises providing the polynucleotide in a composition that further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. In one embodiment the contacting comprises providing the polynucleotide in a composition that can be ingested or otherwise absorbed internally by the *Leptinotarsa* species.

It is anticipated that the combination of certain polynucleotides of use in this method (e.g., the polynucleotide triggers described in the working Examples) with one or more non-polynucleotide pesticidal agents will result in a synergetic improvement in prevention or control of *Leptinotarsa* species infestations, when compared to the effect obtained with the polynucleotide alone or the non-polynucleotide pesticidal agent alone. In an embodiment, a composition containing one or more polynucleotides and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein, is found to effect synergistically improved prevention or control of *Leptinotarsa* species infestations.

Methods of Selecting Target Genes

Another aspect of this invention provides a method of non-random selection of target genes for RNAi-mediated silencing. In an embodiment, the method provides a subset of target genes that are present in single- or low-copy-number (non-repetitive and non-redundant) in a particular genome. Such target genes can be genes from a plant genome or genes from an animal genome. In some embodiments, the target genes are genes of an invertebrate pest, e.g. an invertebrate pest of a plant or an invertebrate pest of a vertebrate. In some embodiments, the target genes are genes of an insect pest of a plant or a nematode pest of a plant. In some embodiments, the target genes are genes of a *Leptinotarsa* species. Further aspects include manufacturing a polynucleotide (e.g., an ssRNA or dsRNA trigger, such as the dsRNA triggers described in the working Examples, or a recombinant DNA construct useful for making transgenic plants) based on target genes for RNAi-mediated silencing selected by any of the methods described herein.

In an embodiment, the method comprises the step of identifying single- or low-copy-number genes in the chosen genome, or alternatively to identify single- or low-copy-number genes in an orthologous database from related organisms to predict which genes will be single/low copy in the chosen organism. Low-copy genes, and in particular single-copy genes, are selected as targets for RNAi-mediated silencing. In one embodiment, the identification of single- or low-copy-number genes is carried out by sequence comparison between a set of genes from a first species and a set of genes from a second species, wherein the set of genes from a second species have been identified as single- or low-copy-number in the second species. In one embodiment, the identification of single- or low-copy-number genes is carried out by applying an algorithm performed by a computer to a set of genes from a first species to identify a subset of single- or low-copy-number genes in the set of genes from the first species, then comparing a set of genes from a second species to the subset of single- or low-copy-number genes from the first species to identify corresponding single- or low-copy-number genes from the second species. The single- or low-copy-number genes from the second species are useful as target genes for RNAi-mediated silencing; the sequences of these target genes are used for designing polynucleotides (e.g., an ssRNA or dsRNA trigger, such as the dsRNA triggers described in the working Examples, or recombinant DNA constructs for making transgenic plants) and methods of use thereof for preventing or controlling infestations by the second species.

Embodiments of the method include a further step of estimating nucleotide diversity for low/single-copy genes in a population of the chosen organism and selecting those low-/single-copy genes that further have the lowest nucleotide diversity. Low-/single-copy genes that further have low nucleotide diversity are selected as targets for RNAi-mediated silencing.

Embodiments of the method include a further step of comparing the ratio of synonymous ($K_s$) to nonsynonymous ($K_a$) nucleotide changes as an estimate of functional or evolutionary constraint. In an embodiment, the method comprises the step of selecting genes where $K_s$ is at least equal to or greater than $K_a$. In an embodiment, the method comprises the step of selecting genes where $K_a>>K_a$.

A related aspect of this invention is a set of target genes for RNAi-mediated silencing identified from a genome by any of the gene selection methods described herein. An embodiment relates to a set of target genes for RNAi-mediated silencing selected from a genome by identifying single- or low-copy-number target genes from a larger set of genes from that genome. One embodiment relates to a set of target genes for RNAi-mediated silencing selected from an invertebrate genome by identifying single- or low-copy-number target genes from a larger set of genes from that invertebrate genome. A specific embodiment relates to a set of target genes for RNAi-mediated silencing in a *Leptinotarsa* species selected from a *Leptinotarsa* genome by identifying single- or low-copy-number target genes from a larger set of genes from that *Leptinotarsa* genome. A specific embodiment relates to a set of target genes for RNAi-mediated silencing in a *Leptinotarsa* species selected from a *Leptinotarsa* genome by identifying single- or low-copy-number target genes from a larger set of genes from that *Leptinotarsa* genome, wherein the set of sequences is the group consisting of SEQ ID NOs:1-725, or the DNA complement thereof.

Related aspects of this invention are methods and compositions utilising the set of target genes consisting of SEQ ID NOs:1-725, or the DNA complement thereof. These include: (i) a method for controlling a *Leptinotarsa* species infestation of a plant comprising contacting the *Leptinotarsa* species with a polynucleotide comprising at least one segment of 18 or more contiguous nucleotides with a sequence of about 95% to about 100% identity with a segment of equivalent length of a DNA having a sequence selected from the group consisting of: SEQ ID NOs:1-725, or the DNA complement thereof; (ii) a method for controlling a *Leptinotarsa* species infestation of a plant comprising providing in the diet of a *Leptinotarsa* species an agent comprising a polynucleotide having at least one segment of 18 or more contiguous nucleotides with a sequence of about 95% to about 100% identity with a segment of equivalent length of a DNA having a sequence selected from the group consisting of: SEQ ID NOs:1-725, or the DNA complement thereof, wherein the agent functions upon ingestion by the *Leptinotarsa* species to inhibit a biological function within the *Leptinotarsa* species thereby controlling infestation by the *Leptinotarsa* species; (iii) a method of causing mortality or stunting in *Leptinotarsa* species larvae comprising providing in the diet of *Leptinotarsa* species larvae at least one recombinant RNA comprising at least one silencing element essentially identical or essentially complementary to a target gene of the *Leptinotarsa* species larvae, wherein the target gene sequence is selected from the group consisting of SEQ ID NOs:1-725; (iv) a method of providing a plant having improved resistance to a *Leptinotarsa* species infestation comprising topically applying to the plant a composition comprising at least one polynucleotide having at least one segment of 18 or more contiguous nucleotides with a sequence of about 95% to about 100% identity with a segment of equivalent length of a DNA having a sequence selected from the group consisting of: SEQ ID NOs:1-725, or the DNA complement thereof; (v) a composition for controlling a *Leptinotarsa* species comprising at least one recombinant polynucleotide comprising at least one segment of 18 or more contiguous nucleotides that is essentially identical or complementary to a segment of equivalent length of a DNA having a sequence selected from the group consisting of SEQ ID NOs:1-725; (vi) a method of providing a plant having improved resistance to a *Leptinotarsa* species infestation comprising expressing in the plant at least one polynucleotide comprising at least one segment of 18 or more contiguous nucleotides that is essentially identical or complementary to a segment of equivalent length of a DNA having a sequence selected from the group consisting of SEQ ID NOs:1-725; (vii) a recombinant DNA construct comprising a heterologous promoter operably linked to DNA comprising at least one segment of 18 or more contiguous nucleotides with a sequence of about 95% to about 100% identity with a segment of equivalent length of a DNA having a sequence selected from the group consisting of: SEQ ID NOs:1-725, or the DNA complement thereof; and (viii) a transgenic solanaceous plant cell having in its genome a recombinant DNA encoding RNA that suppresses expression of a target gene in a *Leptinotarsa* species that contacts or ingests the RNA, wherein the RNA comprises at least one silencing element complementary to the target gene, and wherein the target gene sequence is a sequence selected from the group consisting of: SEQ ID NOs:1-725, or the complement thereof.

Another embodiment relates to a set of target genes for RNAi-mediated silencing selected from a genome by estimating nucleotide diversity for a given set of genes in a population of individuals of the species having that genome, and selecting those genes that have the lowest nucleotide diversity. One embodiment relates to a set of target genes for RNAi-mediated silencing selected from an invertebrate genome by estimating nucleotide diversity for a given set of genes in a population of individuals of the invertebrate having that genome, and selecting those genes that have the lowest nucleotide diversity. Another embodiment relates to a set of target genes for RNAi-mediated silencing selected from an invertebrate genome by estimating nucleotide diversity for low-/single-copy genes in a population of individuals of the invertebrate having that genome, and selecting those low-/single-copy genes that further have the lowest nucleotide diversity.

Another embodiment relates to a set of target genes for RNAi-mediated silencing selected from a genome by comparing the ratio of synonymous ($K_s$) to nonsynonymous ($K_a$) nucleotide changes in genes of that genome and selecting genes where $K_s$ is at least equal to or greater than $K_a$. In an embodiment, the set of target genes for RNAi-mediated silencing are genes where $K_s$ is at least equal to or greater than $K_a$. In an embodiment, the set of target genes for RNAi-mediated silencing are genes where $K_s \gg K_a$. An embodiment relates to a set of target genes for RNAi-mediated silencing selected from an invertebrate genome and where $K_s \gg K_a$ for the selected genes.

In an embodiment, the single- or low-copy-number target genes are a subset of target genes of a first invertebrate species selected from a larger set of genes from the first invertebrate species, wherein the selection is by a sequence comparison performed by a computer between the larger set of genes from the first invertebrate species and a set of genes from a second invertebrate species that have been identified as single- or low-copy-number in the second invertebrate species. In a specific embodiment, the single- or low-copy-number target genes are a subset of *Leptinotarsa decemlineata* target genes selected from a larger set of *Leptinotarsa decemlineata* target genes, wherein the selection is by a sequence comparison performed by a computer between the larger set of *Leptinotarsa decemlineata* target genes and a set of genes from a second invertebrate species that have been identified as single- or low-copy-number in the second invertebrate species. The *Leptinotarsa decemlineata* single- or low-copy-number target genes selected by the method are particularly useful in making polynucleotides of this invention, including recombinant DNA constructs useful, e.g., for providing plants having increased resistance to a *Leptinotarsa* species infestation, and isolated recombinant RNA molecules useful, e.g., in making compositions for topical treatment of a plant or *Leptinotarsa* species to provide prevention or control of a *Leptinotarsa* species infestations. In an embodiment, *Leptinotarsa decemlineata* single- or low-copy-number target genes selected by the method are genes having a sequence selected from the group consisting of SEQ ID NOs:1-725.

A further aspect of this invention are polyclonal or monoclonal antibodies that bind a protein encoded by a sequence or a fragment of a sequence selected from the group consisting of the Target Gene Sequences Group and polyclonal or monoclonal antibodies that bind a protein encoded by a sequence or a fragment of a sequence selected from the Trigger Sequences Group, or the complement thereof; such antibodies are made by routine methods as known to one of ordinary skill in the art, for example using routine protocols as described in "Antibody Methods and Protocols" (Proetzel and Ebersbach, editors, 2012, Humana Press, New York) or "Making and Using Antibodies" (Howard and Kaser, editors, 2006, CRC Press, Boca Raton).

Selection of Effective Polynucleotides by "Tiling"

Polynucleotides of use in the embodiments described herein need not be of the full length of a target gene, and in many embodiments are much shorter than the target gene. An example of a technique that is useful for selecting effective polynucleotides is "tiling", or evaluation of polynucleotides corresponding to adjacent or partially overlapping segments of a target gene.

In some embodiments, effective polynucleotide triggers can be identified by "tiling" gene targets in selected length fragments, e.g., fragments of 200-300 nucleotides in length, with partially overlapping regions, e.g., of about 25 nucleotides, along the length of the target gene. In some embodiments, polynucleotide trigger sequences are designed to correspond to (have a nucleotide identity or complementarity with) regions that are unique to the target gene. In some embodiments, the selected region of the target gene can include coding sequence or non-coding sequence (e.g., promoter regions, 3' untranslated regions, introns and the like) or a combination of both.

Where it is of interest to design a target effective in suppressing multiple target genes, the multiple target gene sequences are aligned and polynucleotide triggers are designed to correspond to regions with high sequence homology in common among the multiple targets. Conversely, where it is of interest to design a target effective in selectively suppressing one among multiple target sequences, the multiple target gene sequences are aligned and polynucleotide triggers designed to correspond to regions with no or low sequence homology in common among the multiple targets.

Thermodynamic Considerations in Selection of Effective Polynucleotides

In some embodiments, polynucleotide triggers can be designed or their sequence optimised using thermodynamic considerations. For example, polynucleotide triggers can be selected based on the thermodynamics controlling hybridization between one nucleic acid strand (e.g., a polynucleotide trigger or an individual siRNA) and another (e.g., a target gene transcript).

Methods and algorithms to predict nucleotide sequences that are likely to be effective at RNAi-mediated silencing of a target gene are known in the art. Non-limiting examples of such methods and algorithms include "i-score", described by Ichihara et al. (2007) *Nucleic Acids Res.*, 35(18): 123e; "Oligowalk", publicly available at rna.urmc.rochester.edu/servers/oligowalk and described by Lu et al. (2008) *Nucleic Acids Res.*, 36:W104-108; and "Reynolds score", described by Khovorova et al. (2004) *Nature Biotechnol.*, 22:326-330.

Permitted Mismatches

By "essentially identical" or "essentially complementary" is meant that a polynucleotide (or at least one strand of a double-stranded polynucleotide) has sufficient identity or complementarity to the target gene or to the RNA transcribed from a target gene (e.g., the transcript) to suppress expression of a target gene (e.g., to effect a reduction in levels or activity of the target gene transcript and/or encoded protein). Polynucleotides as described herein need not have 100 percent identity or complementarity to a target gene or to the RNA transcribed from a target gene to suppress expression of the target gene (e.g., to effect a reduction in levels or activity of the target gene transcript or encoded protein, or to provide control of a *Leptinotarsa* species). In some embodiments, the polynucleotide or a portion thereof is designed to be essentially identical to, or essentially complementary to, a sequence of at least 18 or 19 contiguous nucleotides in either the target gene or the RNA transcribed from the target gene. In some embodiments, the polynucleotide or a portion thereof is designed to be 100% identical to, or 100% complementary to, one or more sequences of 21 contiguous nucleotides in either the target gene or the RNA transcribed from the target gene. In certain embodiments, an "essentially identical" polynucleotide has 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the endogenous target gene or to an RNA transcribed from the target gene. In certain embodiments, an "essentially complementary" polynucleotide has 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene.

Polynucleotides containing mismatches to the target gene or transcript can be used in certain embodiments of the compositions and methods described herein. In some embodiments, the polynucleotide includes at least 18 or at least 19 or at least 21 contiguous nucleotides that are essentially identical or essentially complementary to a segment of equivalent length in the target gene or target gene's transcript. In certain embodiments, a polynucleotide of 21 or more contiguous nucleotides that is essentially identical or essentially complementary to a segment of equivalent length in the target gene or target gene's transcript can have 1 or 2 mismatches to the target gene or transcript (i.e., 1 or 2 mismatches between the polynucleotide's 21 contiguous nucleotides and the segment of equivalent length in the target gene or target gene's transcript). In certain embodiments, a polynucleotide of about 50, 100, 150, 200, 250, 300, 350 or more nucleotides that contains a contiguous 21 nucleotide span of identity or complementarity to a segment of equivalent length in the target gene or target gene's transcript can have 1 or 2 or more mismatches to the target gene or transcript.

In designing polynucleotides with mismatches to an endogenous target gene or to an RNA transcribed from the target gene, mismatches of certain types and at certain positions that are more likely to be tolerated can be used. In certain embodiments, mismatches formed between adenine and cytosine or guanosine and uracil residues are used as described by Du et al. (2005) *Nucleic Acids Res.*, 33:1671-1677. In some embodiments, mismatches in 19 base-pair overlap regions are located at the low tolerance positions 5, 7, 8 or 11 (from the 5' end of a 19-nucleotide target), at medium tolerance positions 3, 4, and 12-17 (from the 5' end of a 19-nucleotide target), and/or at the high tolerance positions at either end of the region of complementarity, i.e., positions 1, 2, 18, and 19 (from the 5' end of a 19-nucleotide target) as described by Du et al. (2005) *Nucleic Acids Res.*, 33:1671-1677. Tolerated mismatches can be empirically determined in routine assays, e.g., in in vitro dietary assays on *Leptinotarsa* species larvae.

Embedding Silencing Elements in Neutral Sequence

In some embodiments, a silencing element comprising a sequence corresponding to the target gene and which is responsible for an observed suppression of the target gene is embedded in "neutral" sequence, i.e., inserted into additional nucleotides that have no sequence identity or complementarity to the target gene. Neutral sequence can be desirable, e.g., to increase the overall length of a polynucleotide. For example, it can be desirable for a polynucleotide to be of a particular size for reasons of stability, cost-effectiveness in manufacturing, or biological activity. In some embodiments, neutral sequence is also useful in forming the loop in a hairpin trigger or as a spacer between trigger regions.

It has been reported that in another coleopteran species, *Diabrotica virgifera*, dsRNAs greater than or equal to approximately 60 base-pairs (bp) are required for biological activity in artificial diet bioassays; see Bolognesi et al. (2012) PLoS ONE 7(10): e47534. doi:10.1371/journal.pone.0047534. Thus, in one embodiment, a 21-base-pair dsRNA silencing element corresponding to a target gene in Table 1 and found to provide control of a *Leptinotarsa* infestation is embedded in neutral sequence of an additional 39 base pairs, thus forming a polynucleotide of about 60 base pairs. In some embodiments, the dsRNA trigger includes neutral sequence of between about 60 to about 500, or between 100 to about 450 base-pairs, in which is embedded at least one segment of 21 contiguous nucleotides with a sequence of 100% identity or 100% complementarity with a fragment of equivalent length of a target gene having a sequence selected from the group consisting of SEQ ID NOs:1-725 and SEQ ID NOs:726-830 and SEQ ID NOs:1087-1094. In another embodiment, a single 21-base-pair silencing element with a sequence of 100% identity or 100% complementarity with a fragment of equivalent length of a target gene is found to be efficacious when embedded in larger sections of neutral sequence, e.g., where the total polynucleotide length is from about 60 to about 300 base pairs. In another embodiment, at least one segment of at least 21 contiguous nucleotides of a sequence selected from the group consisting of: SEQ ID NOs:831-1085, 1095-1104, and 1110-1114, or the complement thereof, is embedded in larger sections of neutral sequence to provide an efficacious polynucleotide. In another embodiment, segments from multiple sequences (or multiple copies of a segment from one or more sequences) selected from the group consisting of: SEQ ID NOs:831-1085, 1095-1104, and 1110-1114, or the complement thereof, are embedded in larger sections of neutral sequence to provide an efficacious polynucleotide. In embodiments where the polynucleotide includes regions of neutral sequence, the polynucleotide will have relatively low overall sequence identity in comparison to the target gene; for example, a dsRNA with an overall length of 210 base-pairs, containing a single 21-base-pair trigger (of 100% identity or complementarity to a 21-nucleotide fragment of a target gene) embedded in an additional 189 base-pairs of neutral sequence, will have an overall sequence identity with the target gene of about 10%.

Insecticidal Double-Stranded RNA Molecules

Another aspect of this invention provides an insecticidal double-stranded RNA molecule that causes mortality or stunting of growth in a *Leptinotarsa* species when ingested or contacted by the *Leptinotarsa* species, wherein the insecticidal double-stranded RNA molecule comprises at least one segment of 18 or more contiguous nucleotides that is essentially identical or essentially complementary to a segment of equivalent length of a target gene or DNA (cDNA) having a sequence selected from The Target Gene Sequences Group. In some embodiments, the insecticidal double-stranded RNA molecule is between about 50 to about 500 base-pairs in length. In some embodiments, the insecticidal double-stranded RNA molecule comprises at least one segment of at least 30 contiguous nucleotides in length. In some embodiments, the insecticidal double-stranded RNA molecule comprises multiple segments of 18 or more contiguous nucleotides that are essentially identical or essentially complementary to a segment of equivalent length of a target gene or DNA (cDNA) having a sequence selected from The Target Gene Sequences Group, wherein the segments are from different regions of the target gene (e.g., the segments can correspond to different exon regions of the target gene, and "spacer" nucleotides which do not correspond to a target gene can optionally be used in between or adjacent to the segments), or are from different target genes. In some embodiments, the insecticidal double-stranded RNA molecule comprises multiple segments of 18 or more contiguous nucleotides that are essentially identical or essentially complementary to a segment of equivalent length of a target gene or DNA (cDNA) having a sequence selected from The Target Gene Sequences Group, wherein the segments are from different regions of the target gene and are arranged in the insecticidal double-stranded RNA molecule in an order different from the order in which the segments naturally occur in the target gene. In some embodiments, the insecticidal double-stranded RNA molecule comprises multiple segments each of 21 contiguous nucleotides with a sequence of 100% identity or 100% complementary to a segment of equivalent length of a target gene or DNA (cDNA) having a sequence selected from The Target Gene Sequences Group, wherein the segments are from different regions of the target gene and are arranged in the insecticidal double-stranded RNA molecule in an order different from the order in which the segments naturally occur in the target gene. In some embodiments, the insecticidal double-stranded RNA molecule comprises one strand comprising a sequence selected from the group consisting of: SEQ ID NOs:831-1085, 1095-1104, and 1110-1114, or the complement thereof, or comprises an RNA hairpin encoded by a sequence selected from the group consisting of SEQ ID NOs:1105-1109. In some embodiments the insecticidal double-stranded RNA comprises a dsRNA with a strand having a sequence selected from the group consisting of the Trigger Sequences Group. The insecticidal double-stranded RNA molecule can be topically applied to a plant, especially a solanaceous plant such as tomato, eggplant, or potato, to control or prevent infestation by a *Leptinotarsa* species. The insecticidal double-stranded RNA molecule can be provided in a form suitable for ingestion or direct contact by a *Leptinotarsa* species, e.g., in the form of a spray or powder or bait. Other methods and suitable compositions for providing the insecticidal double-stranded RNA molecule are similar to those described in the preceding paragraphs for other aspects of this invention.

Several embodiments relate to a tank mixture comprising one or more insecticidal polynucleotides and water or other solvent, optionally including a cationic lipid or an organosilicone surfactant or both. Embodiments include tank mixture formulations of the polynucleotide and optionally at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. Embodiments of such compositions include those where one or more insecticidal polynucleotides are provided in a living or dead microorganism such as a bacterium or fungal or yeast cell, or provided as a microbial fermentation product, or provided in a living or dead plant cell, or provided as a synthetic recombinant polynucleotide. In an embodiment the composition includes a non-pathogenic strain of a microorganism that contains a polynucleotide as described herein; ingestion or intake of the microorganism results in stunting or mortality of the *Leptinotarsa* species; non-limiting examples of suitable microorganisms include *E. coli, B. thuringiensis, Pseudomonas* sp., *Photorhabdus* sp., *Xenorhabdus* sp., *Serratia entomophila* and related *Serratia* sp., *B. sphaericus, B. cereus, B. laterosporus, B. popilliae, Clostridium bifermentans* and other *Clostridium* species, or other spore-forming gram-positive bacteria. In an embodiment, the composition includes a plant virus vector comprising a polynucleotide as described herein; feeding by a *Leptinotarsa* species on a plant treated with the plant virus vector results in stunting or mortality of the *Leptinotarsa* species. In an embodiment, the composition includes a baculovirus vector including a polynucleotide as described herein; ingestion or intake of the vector results in stunting or mortality of the *Leptinotarsa* species. In an embodiment, a polynucleotide as described herein is encapsulated in a synthetic matrix such as a polymer or attached to particulates and topically applied to the surface of a plant; feeding by a *Leptinotarsa* species on the topically treated plant results in stunting or mortality of the *Leptinotarsa* species. In an embodiment, a polynucleotide as described herein is provided in the form of a plant cell (e.g., a transgenic solanaceous plant cell of this invention) expressing the polynucleotide; ingestion of the plant cell or contents of the plant cell by a *Leptinotarsa* species results in stunting or mortality of the *Leptinotarsa* species.

In some embodiments, one or more polynucleotides as described herein are provided with appropriate stickers and wetters required for efficient foliar coverage as well as UV protectants to protect polynucleotides such as dsRNAs from UV damage. Such additives are commonly used in the bioinsecticide industry and are known to those skilled in the art. Compositions for soil application can include granular formulations that serve as bait for *Leptinotarsa* species larvae. In some embodiments, one or more polynucleotides as described herein are further provided with a carrier agent, a surfactant, a cationic lipid (such as that disclosed in Example 18 of U.S. patent application publication 2011/

0296556, incorporated by reference herein), an organosilicone, an organosilicone surfactant, a polynucleotide herbicidal molecule, a non-polynucleotide herbicidal molecule, a non-polynucleotide pesticide, a safener, and an insect growth regulator. In some embodiments, the composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

Such compositions are applied in any convenient manner, e.g., by spraying or dusting the *Leptinotarsa* species directly, or spraying or dusting a plant or environment wherein prevention or control of infestation by that *Leptinotarsa* species is desired, or by applying a coating to a surface of a plant, or by applying a coating to a seed (or seed potato) in preparation for the seed's planting, or by applying a soil drench around roots of a plant for which prevention or control of infestation by that *Leptinotarsa* species is desired.

An effective amount of a polynucleotide as described herein is an amount sufficient to provide control of the *Leptinotarsa* species, or to prevent infestation by the *Leptinotarsa* species; determination of effective amounts of a polynucleotide are made using routine assays such as those described in Examples 5 and 6. While there is no upper limit on the concentrations and dosages of an insecticidal polynucleotide that can be useful in the methods and compositions provided herein, lower effective concentrations and dosages will generally be sought for efficiency and economy. Non-limiting embodiments of effective amounts of a polynucleotide include a range from about 10 nanograms per milliliter to about 100 micrograms per milliliter of a polynucleotide in a liquid form sprayed on a plant, or from about 10 milligrams per acre to about 100 grams per acre of polynucleotide applied to a field of plants, or from about 0.001 to about 0.1 microgram per milliliter of polynucleotide in an artificial diet for feeding the *Leptinotarsa* species. Where polynucleotides as described herein are topically applied to a plant, the concentrations can be adjusted in consideration of the volume of spray or treatment applied to plant leaves or other plant part surfaces, such as flower petals, stems, tubers, fruit, anthers, pollen, leaves, roots, or seeds. In one embodiment, a useful treatment for herbaceous plants using 25-mer polynucleotides as described herein is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a ssDNA polynucleotide are applied. In certain embodiments, about 0.5 nmol to about 2 nmol of a dsRNA is applied. In certain embodiments, a composition containing about 0.5 to about 2.0 milligrams per milliliter, or about 0.14 milligrams per milliliter of a dsRNA or an ssDNA (21-mer) is applied. In certain embodiments, a composition of about 0.5 to about 1.5 milligrams per milliliter of a dsRNA polynucleotide of this invention of about 50 to about 200 or more nucleotides is applied. In certain embodiments, about 1 nmol to about 5 nmol of a dsRNA of this invention is applied to a plant. In certain embodiments, the polynucleotide composition as topically applied to the plant contains at least one polynucleotide of this invention at a concentration of about 0.01 to about 10 milligrams per milliliter, or about 0.05 to about 2 milligrams per milliliter, or about 0.1 to about 2 milligrams per milliliter. Very large plants, trees, or vines can require correspondingly larger amounts of polynucleotides. When using long dsRNA molecules of this invention that can be processed into multiple oligonucleotides (e.g., multiple triggers encoded by a single recombinant DNA molecule of this invention), lower concentrations can be used. Non-limiting examples of effective polynucleotide treatment regimes include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

In some embodiments, one or more polynucleotides is provided with a "transfer agent", which is an agent that enables a topically applied polynucleotide to enter the cells of an organism. Such transfer agents can be incorporated as part of a composition comprising a polynucleotide as described herein, or can be applied prior to, contemporaneously with, or following application of the polynucleotide. In some embodiments, a transfer agent is an agent that improves the uptake of a polynucleotide of this invention by a *Leptinotarsa* species. In some embodiments, a transfer agent is an agent that conditions the surface of plant tissue, e.g., seeds, leaves, stems, roots, flowers, or fruits, to permeation by a polynucleotide into plant cells. In some embodiments, the transfer agent enables a pathway for a polynucleotide through cuticle wax barriers, stomata, and/or cell wall or membrane barriers into plant cells.

Suitable transfer agents include agents that increase permeability of the exterior of the organism or that increase permeability of cells of the organism to polynucleotides. Suitable transfer agents include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or any combination thereof. In some embodiments, application of a polynucleotide and a transfer agent optionally includes an incubation step, a neutralization step (e.g., to neutralize an acid, base, or oxidizing agent, or to inactivate an enzyme), a rinsing step, or combinations thereof. Suitable transfer agents can be in the form of an emulsion, a reverse emulsion, a liposome, or other micellar-like composition, or can cause the polynucleotide to take the form of an emulsion, a reverse emulsion, a liposome, or other micellar-like composition. Embodiments of transfer agents include counter-ions or other molecules that are known to associate with nucleic acid molecules, e.g., inorganic ammonium ions, alkyl ammonium ions, lithium ions, polyamines such as spermine, spermidine, or putrescine, and other cations. Embodiments of transfer agents include organic solvents such as DMSO, DMF, pyridine, N-pyrrolidine, hexamethylphosphoramide, acetonitrile, dioxane, polypropylene glycol, or other solvents miscible with water or that dissolve phosphonucleotides in non-aqueous systems (such as is used in synthetic reactions). Embodiments of transfer agents include naturally derived or synthetic oils with or without surfactants or emulsifiers, e.g., plant-sourced oils, crop oils (such as those listed in the $9^{th}$ Compendium of Herbicide Adjuvants, publicly available on-line at herbicide-.adjuvants.com), paraffinic oils, polyol fatty acid esters, or oils with short-chain molecules modified with amides or polyamines such as polyethyleneimine or N-pyrrolidine.

Embodiments of transfer agents include organosilicone preparations. For example, a suitable transfer agent is an organosilicone preparation that is commercially available as SILWET L-77® brand surfactant having CAS Number 27306-78-1 and EPA Number: CAL.REG.NO. 5905-50073-AA, and currently available from Momentive Performance Materials, Albany, N.Y. One embodiment includes a composition that comprises a polynucleotide and a transfer agent including an organosilicone preparation such as Silwet L-77 in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent). One embodiment includes a composition that comprises a polynucleotide of this invention and a transfer agent including SILWET L-77® brand surfactant in the range of about 0.3 to about 1 percent by weight (wt percent) or about 0.5 to about 1%, by weight (wt percent).

Organosilicone compounds useful as transfer agents for use in this invention include, but are not limited to, compounds that include: (a) a trisiloxane head group that is covalently linked to, (b) an alkyl linker including, but not limited to, an n-propyl linker, that is covalently linked to, (c) a polyglycol chain, that is covalently linked to, (d) a terminal group. Trisiloxane head groups of such organosilicone compounds include, but are not limited to, heptamethyltrisiloxane. Alkyl linkers can include, but are not limited to, an n-propyl linker. Polyglycol chains include, but are not limited to, polyethylene glycol or polypropylene glycol. Polyglycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Organosilicone compounds useful as transfer agents include, but are not limited to, trisiloxane ethoxylate surfactants or polyalkylene oxide modified heptamethyl trisiloxane. An example of a transfer agent for use in this invention is Compound I:

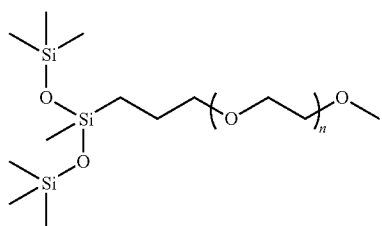

(Compound I: polyalkyleneoxide heptamethyltrisiloxane, average n=7.5).

Organosilicone compounds useful as transfer agents are used, e.g., as freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent).

Embodiments of transfer agents include one or more salts such as ammonium chloride, tetrabutylphosphonium bromide, and ammonium sulfate, provided in or used with a composition including a polynucleotide. In some embodiments, ammonium chloride, tetrabutylphosphonium bromide, and/or ammonium sulfate are used at a concentration of about 0.5% to about 5% (w/v), or about 1% to about 3% (w/v), or about 2% (w/v). In certain embodiments, the composition including a polynucleotide includes an ammonium salt at a concentration greater or equal to 300 millimolar. In certain embodiments, the composition including a polynucleotide includes an organosilicone transfer agent in a concentration of about 0.015 to about 2 percent by weight (wt percent) as well as ammonium sulfate at concentrations from about 80 to about 1200 mM or about 150 mM to about 600 mM.

Embodiments of transfer agents include a phosphate salt. Phosphate salts useful in a composition including a polynucleotide include, but are not limited to, calcium, magnesium, potassium, or sodium phosphate salts. In certain embodiments, a composition including a polynucleotide includes a phosphate salt at a concentration of at least about 5 millimolar, at least about 10 millimolar, or at least about 20 millimolar. In certain embodiments, a composition including a polynucleotide a phosphate salt in a range of about 1 mM to about 25 mM or in a range of about 5 mM to about 25 mM. In certain embodiments, the composition including a polynucleotide sodium phosphate at a concentration of at least about 5 millimolar, at least about 10 millimolar, or at least about 20 millimolar. In certain embodiments, a composition including a polynucleotide includes sodium phosphate at a concentration of about 5 millimolar, about 10 millimolar, or about 20 millimolar. In certain embodiments, a composition including a polynucleotide includes a sodium phosphate salt in a range of about 1 mM to about 25 mM or in a range of about 5 mM to about 25 mM. In certain embodiments, a composition including a polynucleotide includes a sodium phosphate salt in a range of about 10 mM to about 160 mM or in a range of about 20 mM to about 40 mM. In certain embodiments, a composition including a polynucleotide includes a sodium phosphate buffer at a pH of about 6.8.

Embodiments of transfer agents include surfactants and/or effective molecules contained therein. Surfactants and/or effective molecules contained therein include, but are not limited to, sodium or lithium salts of fatty acids (such as tallow or tallowamines or phospholipids) and organosilicone surfactants. In certain embodiments, a composition including a polynucleotide is formulated with counter-ions or other molecules that are known to associate with nucleic acid molecules. Non-limiting examples include, tetraalkyl ammonium ions, trialkyl ammonium ions, sulfonium ions, lithium ions, and polyamines such as spermine, spermidine, or putrescine. In certain embodiments, a composition including a polynucleotide is formulated with a non-polynucleotide herbicide e.g., glyphosate, auxin-like benzoic acid herbicides including dicamba, chloramben, and TBA, glufosinate, auxin-like herbicides including phenoxy carboxylic acid herbicide, pyridine carboxylic acid herbicide, quinoline carboxylic acid herbicide, pyrimidine carboxylic acid herbicide, and benazolin-ethyl herbicide, sulfonylureas, imidazolinones, bromoxynil, delapon, cyclohezanedione, protoporphyrinogen oxidase inhibitors, and 4-hydroxyphenyl-pyruvate-dioxygenase inhibiting herbicides. In certain embodiments, a composition including a polynucleotide is formulated with a non-polynucleotide pesticide, e.g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein. In some embodiments, a composition including a polynucleotide and a non-polynucleotide pesticide provides synergetic improvement in prevention or control of *Leptinotarsa* species infestations, when compared to the effect obtained with the polynucleotide alone or the non-polynucleotide pesticide alone. In some embodiments, a composition comprising a double-stranded RNA with a strand having a sequence selected from the group consisting of the Trigger Sequences Group is combined with a non-polynucleotide pesticide (e.g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein), wherein the combination is found to effect synergistically improved prevention or control of *Leptinotarsa* species infestations, when compared to the effect obtained with the double-stranded RNA alone or the non-polynucleotide pesticide alone.

Related Techniques

Embodiments of the polynucleotides and nucleic acid molecules as described herein can include additional elements, such as promoters, small RNA recognition sites, aptamers or ribozymes, additional and additional expression cassettes for expressing coding sequences (e.g., to express a transgene such as an insecticidal protein or selectable marker) or non-coding sequences (e.g., to express additional suppression elements). For example, an aspect of this invention provides a recombinant DNA construct comprising a heterologous promoter operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. Another aspect of the invention provides a recombinant DNA construct comprising a heterologous promoter operably linked to DNA encoding an RNA hairpin having an anti-sense region having a sequence, or a fragment of a sequence, selected from the group selected from the Trigger Sequences Group. In another embodiment, a recombinant DNA construct comprising a promoter operably linked to DNA encoding: (a) an RNA silencing element for suppressing a target gene selected from the group consisting of the genes identified in Table 1), and (b) an aptamer, is stably integrated into the plant's genome from where RNA transcripts including the RNA aptamer and the RNA silencing element are expressed in cells of the plant; the aptamer serves to guide the RNA silencing element to a desired location in the cell. In another embodiment, inclusion of one or more recognition sites for binding and cleavage by a small RNA (e.g., by a miRNA or an siRNA that is expressed only in a particular cell or tissue) allows for more precise expression patterns in a plant, wherein the expression of the recombinant DNA construct is suppressed where the small RNA is expressed. Such additional elements are described below.

Promoters

Promoters of use in the invention are functional in the cell in which the construct is intended to be transcribed. Generally these promoters are heterologous promoters, as used in recombinant constructs, i.e., they are not in nature found to be operably linked to the other nucleic elements used in the constructs described herein. In various embodiments, the promoter is selected from the group consisting of a constitutive promoter, a spatially specific promoter, a temporally specific promoter, a developmentally specific promoter, and an inducible promoter. In many embodiments the promoter is a promoter functional in a plant, for example, a pol II promoter, a pol III promoter, a pol IV promoter, or a pol V promoter.

Non-constitutive promoters suitable for use with the recombinant DNA constructs of this invention include spatially specific promoters, temporally specific promoters, and inducible promoters. Spatially specific promoters can include organelle-, cell-, tissue-, or organ-specific promoters (e.g., a plastid-specific, a root-specific, a pollen-specific, or a seed-specific promoter for expression in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e.g., water deficit or drought, heat, cold, high or low nutrient or salt levels, high or low light levels, or pest or pathogen infection). MicroRNA promoters are useful, especially those having a temporally specific, spatially specific, or inducible expression pattern; examples of miRNA promoters, as well as methods for identifying miRNA promoters having specific expression patterns, are provided in U.S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters of particular interest include the following examples: an opaline synthase promoter isolated from T-DNA of *Agrobacterium*; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of *Zea mays*); root specific promoters such as those disclosed in U.S. Pat. Nos. 5,837,848; 6,437,217 and 6,426,446; a maize L3 oleosin promoter disclosed in U.S. Pat. No. 6,433,252; a promoter for a plant nuclear gene encoding a plastid-localized aldolase disclosed in U.S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include a rolC or rolA promoter of *Agrobacterium rhizogenes*, a promoter of a *Agrobacterium tumefaciens* T-DNA gene 5, the rice sucrose synthase RSs1 gene promoter, a *Commelina* yellow mottle badnavirus promoter, a coconut foliar decay virus promoter, a rice tungro bacilliform virus promoter, the promoter of a pea glutamine synthase GS3A gene, a invCD111 and invCD141 promoters of a potato invertase genes, a promoter isolated from *Arabidopsis* shown to have phloem-specific expression in tobacco by Kertbundit et al. (1991) *Proc. Natl. Acad. Sci. USA.*, 88:5212-5216, a VAHOX1 promoter region, a pea cell wall invertase gene promoter, an acid invertase gene promoter from carrot, a promoter of a sulfate transporter gene Sultr1;3, a promoter of a plant sucrose synthase gene, and a promoter of a plant sucrose transporter gene.

Promoters suitable for use with a recombinant DNA construct or polynucleotide of this invention include polymerase II ("pol II") promoters and polymerase III ("pol III")

promoters. RNA polymerase II transcribes structural or catalytic RNAs that are usually shorter than 400 nucleotides in length, and recognizes a simple run of T residues as a termination signal; it has been used to transcribe siRNA duplexes (see, e.g., Lu et al. (2004) *Nucleic Acids Res.*, 32:e171). Pol II promoters are therefore in certain embodiments where a short RNA transcript is to be produced from a recombinant DNA construct of this invention. In one embodiment, the recombinant DNA construct comprises a pol II promoter to express an RNA transcript flanked by self-cleaving ribozyme sequences (e.g., self-cleaving hammerhead ribozymes), resulting in a processed RNA, such as a single-stranded RNA that binds to the transcript of the *Leptinotarsa* target gene, with defined 5' and 3' ends, free of potentially interfering flanking sequences. An alternative approach uses pol III promoters to generate transcripts with relatively defined 5' and 3' ends, i.e., to transcribe an RNA with minimal 5' and 3' flanking sequences. In some embodiments, Pol III promoters (e.g., U6 or H1 promoters) are for adding a short AT-rich transcription termination site that results in 2 base-pair overhangs (UU) in the transcribed RNA; this is useful, e.g., for expression of siRNA-type constructs. Use of pol III promoters for driving expression of siRNA constructs has been reported; see van de Wetering et al. (2003) *EMBO Rep.,* 4: 609-615, and Tuschl (2002) *Nature Biotechnol.,* 20: 446-448. Baculovirus promoters such as baculovirus polyhedrin and p10 promoters are known in the art and commercially available; see, e.g., Invitrogen's "Guide to Baculovirus Expression Vector Systems (BEVS) and Insect Cell Culture Techniques", 2002 (Life Technologies, Carlsbad, Calif.) and F. J. Haines et al. "Baculovirus Expression Vectors", undated (Oxford Expression Technologies, Oxford, UK).

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer (see "Aptamers", below) and a regulatory region (which can be cis-acting). See, for example, Isaacs et al. (2004) *Nat. Biotechnol.,* 22:841-847, Bayer and Smolke (2005) *Nature Biotechnol.,* 23:337-343, Mandal and Breaker (2004) *Nature Rev. Mol. Cell Biol.,* 5:451-463, Davidson and Ellington (2005) *Trends Biotechnol.,* 23:109-112, Winkler et al. (2002) *Nature,* 419:952-956, Sudarsan et al. (2003) *RNA,* 9:644-647, and Mandal and Breaker (2004) *Nature Struct. Mol. Biol.,* 11:29-35. Such "riboregulators" could be selected or designed for specific spatial or temporal specificity, for example, to regulate translation of DNA that encodes a silencing element for suppressing a *Leptinotarsa* target gene only in the presence (or absence) of a given concentration of the appropriate ligand. One example is a riboregulator that is responsive to an endogenous ligand (e.g., jasmonic acid or salicylic acid) produced by the plant when under stress (e.g., abiotic stress such as water, temperature, or nutrient stress, or biotic stress such as attach by pests or pathogens); under stress, the level of endogenous ligand increases to a level sufficient for the riboregulator to begin transcription of the DNA that encodes a silencing element for suppressing a *Leptinotarsa* target gene.

Recombinase Sites

In some embodiments, the recombinant DNA construct or polynucleotide of this invention comprises DNA encoding one or more site-specific recombinase recognition sites. In one embodiment, the recombinant DNA construct comprises at least a pair of loxP sites, wherein site-specific recombination of DNA between the loxP sites is mediated by a Cre recombinase. The position and relative orientation of the loxP sites is selected to achieve the desired recombination; for example, when the loxP sites are in the same orientation, the DNA between the loxP sites is excised in circular form. In another embodiment, the recombinant DNA construct comprises DNA encoding one loxP site; in the presence of Cre recombinase and another DNA with a loxP site, the two DNAs are recombined.

Aptamers

In some embodiments, the recombinant DNA construct or polynucleotide of this invention comprises DNA that is processed to an RNA aptamer, that is, an RNA that binds to a ligand through binding mechanism that is not primarily based on Watson-Crick base-pairing (in contrast, for example, to the base-pairing that occurs between complementary, anti-parallel nucleic acid strands to form a double-stranded nucleic acid structure). See, for example, Ellington and Szostak (1990) *Nature,* 346:818-822. Examples of aptamers can be found, for example, in the public Aptamer Database, available on line at aptamer.icmb.utexas.edu (Lee et al. (2004) *Nucleic Acids Res.,* 32(1):D95-100). Aptamers useful in the invention can, however, be monovalent (binding a single ligand) or multivalent (binding more than one individual ligand, e.g., binding one unit of two or more different ligands).

Ligands useful in the invention include any molecule (or part of a molecule) that can be recognized and be bound by a nucleic acid secondary structure by a mechanism not primarily based on Watson-Crick base pairing. In this way, the recognition and binding of ligand and aptamer is analogous to that of antigen and antibody, or of biological effector and receptor. Ligands can include single molecules (or part of a molecule), or a combination of two or more molecules (or parts of a molecule), and can include one or more macromolecular complexes (e.g., polymers, lipid bilayers, liposomes, cellular membranes or other cellular structures, or cell surfaces). Examples of specific ligands include vitamins such as coenzyme $B_{12}$ and thiamine pyrophosphate, flavin mononucleotide, guanine, adenosine, S-adenosylmethionine, S-adenosylhomocysteine, coenzyme A, lysine, tyrosine, dopamine, glucosamine-6-phosphate, caffeine, theophylline, antibiotics such as chloramphenicol and neomycin, herbicides such as glyphosate and dicamba, proteins including viral or phage coat proteins and invertebrate epidermal or digestive tract surface proteins, and RNAs including viral RNA, transfer-RNAs (t-RNAs), ribosomal RNA (rRNA), and RNA polymerases such as RNA-dependent RNA polymerase (RdRP). One class of RNA aptamers useful in the invention are "thermoswitches" that do not bind a ligand but are thermally responsive, that is to say, the aptamer's conformation is determined by temperature; see, for example, Box 3 in Mandal and Breaker (2004) *Nature Rev. Mol. Cell Biol.,* 5:451-463.

Transgene Transcription Units

In some embodiments, the recombinant DNA construct or polynucleotide of this invention comprises a transgene transcription unit. A transgene transcription unit comprises DNA sequence encoding a gene of interest, e.g., a natural protein or a heterologous protein. A gene of interest can be any coding or non-coding sequence from any species (including, but not limited to, non-eukaryotes such as bacteria, and viruses; fungi, protists, plants, invertebrates, and vertebrates. Particular genes of interest are genes encoding at least one pesticidal agent selected from the group consisting of a patatin, a plant lectin, a phytoecdysteroid, a phytoecdysteroid, a *Bacillus thuringiensis* insecticidal protein, a *Xeno-*

*rhabdus* insecticidal protein, a *Photorhabdus* insecticidal protein, a *Bacillus laterosporous* insecticidal protein, and a *Bacillus sphaericus* insecticidal protein. The transgene transcription unit can further include 5' or 3' sequence or both as required for transcription of the transgene.

Introns

In some embodiments, the recombinant DNA construct or polynucleotide of this invention comprises DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus in eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e.g., the tobacco mosaic virus 5' leader sequence or "omega" leader described as enhancing expression in plant genes by Gallie and Walbot (1992) *Nucleic Acids Res.*, 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

Ribozymes

In some embodiments, the recombinant DNA construct or polynucleotide of this invention comprises DNA encoding one or more ribozymes. Ribozymes of particular interest include a self-cleaving ribozyme, a hammerhead ribozyme, or a hairpin ribozyme. In one embodiment, the recombinant DNA construct comprises DNA encoding one or more ribozymes that serve to cleave the transcribed RNA to provide defined segments of RNA, such as silencing elements for suppressing a *Leptinotarsa* target gene.

Gene Suppression Elements

In some embodiments, the recombinant DNA construct or polynucleotide of this invention comprises DNA encoding additional gene suppression element for suppressing a target gene other than a *Leptinotarsa* target gene. The target gene to be suppressed can include coding or non-coding sequence or both.

Suitable gene suppression elements are described in detail in U.S. Patent Application Publication 2006/0200878, which disclosure is specifically incorporated herein by reference, and include one or more of:

(a) DNA that comprises at least one anti-sense DNA segment that is anti-sense to at least one segment of the gene to be suppressed;
(b) DNA that comprises multiple copies of at least one anti-sense DNA segment that is anti-sense to at least one segment of the gene to be suppressed;
(c) DNA that comprises at least one sense DNA segment that is at least one segment of the gene to be suppressed;
(d) DNA that comprises multiple copies of at least one sense DNA segment that is at least one segment of the gene to be suppressed;
(e) DNA that transcribes to RNA for suppressing the gene to be suppressed by forming double-stranded RNA and comprises at least one anti-sense DNA segment that is anti-sense to at least one segment of the gene to be suppressed and at least one sense DNA segment that is at least one segment of the gene to be suppressed;
(f) DNA that transcribes to RNA for suppressing the gene to be suppressed by forming a single double-stranded RNA and comprises multiple serial anti-sense DNA segments that are anti-sense to at least one segment of the gene to be suppressed and multiple serial sense DNA segments that are at least one segment of the gene to be suppressed;
(g) DNA that transcribes to RNA for suppressing the gene to be suppressed by forming multiple double strands of RNA and comprises multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;
(h) DNA that comprises nucleotides derived from a plant miRNA;
(i) DNA that comprises nucleotides of a siRNA;
(j) DNA that transcribes to an RNA aptamer capable of binding to a ligand; and
(k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron, is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

Transcription Regulatory Elements

In some embodiments, the recombinant DNA construct or polynucleotide of this invention comprises DNA encoding a transcription regulatory element. Transcription regulatory elements include elements that regulate the expression level of the recombinant DNA construct of this invention (relative to its expression in the absence of such regulatory elements). Examples of suitable transcription regulatory elements include riboswitches (cis- or trans-acting), transcript stabilizing sequences, and miRNA recognition sites, as described in detail in U.S. Patent Application Publication 2006/0200878, specifically incorporated herein by reference.

Making and Using Transgenic Plant Cells and Transgenic Plants

Transformation of a plant can include any of several well-known methods and compositions. Suitable methods for plant transformation include virtually any method by which DNA can be introduced into a cell. One method of plant transformation is microprojectile bombardment, for example, as illustrated in U.S. Pat. No. 5,015,580 (soybean), U.S. Pat. No. 5,538,880 (maize), U.S. Pat. No. 5,550,318 (maize), U.S. Pat. No. 5,914,451 (soybean), U.S. Pat. No. 6,153,812 (wheat), U.S. Pat. No. 6,160,208 (maize), U.S. Pat. No. 6,288,312 (rice), U.S. Pat. No. 6,365,807 (rice), and U.S. Pat. No. 6,399,861 (maize), and U.S. Pat. No. 6,403,865 (maize), all of which are incorporated by reference for enabling the production of transgenic plants.

Another useful method of plant transformation is *Agrobacterium*-mediated transformation by means of *Agrobacterium* containing a binary Ti plasmid system, wherein the *Agrobacterium* carries a first Ti plasmid and a second, chimeric plasmid containing at least one T-DNA border of a wild-type Ti plasmid, a promoter functional in the transformed plant cell and operably linked to a polynucleotide or recombinant DNA construct of this invention. See, for example, the binary system described in U.S. Pat. No. 5,159,135, incorporated by reference. Also see De Framond (1983) *Biotechnology*, 1:262-269; and Hoekema et al., (1983) *Nature*, 303:179. In such a binary system, the smaller plasmid, containing the T-DNA border or borders, can be conveniently constructed and manipulated in a suitable alternative host, such as *E. coli*, and then transferred into *Agrobacterium*.

Detailed procedures for *Agrobacterium*-mediated transformation of plants, especially crop plants, include procedures disclosed in U.S. Pat. Nos. 5,004,863, 5,159,135, and 5,518,908 (cotton); U.S. Pat. Nos. 5,416,011, 5,569,834, 5,824,877 and 6,384,301 (soybean); U.S. Pat. Nos. 5,591,616 and 5,981,840 (maize); 5,463,174 (brassicas including canola), 7,026,528 (wheat), and 6,329,571 (rice), and in U.S. Patent Application Publications 2004/0244075 (maize) and 2001/0042257 A1 (sugar beet), all of which are specifically incorporated by reference for enabling the production of transgenic plants. U. S. Patent Application Publication 2011/0296555 discloses in Example 5 the transformation vectors (including the vector sequences) and detailed protocols for transforming maize, soybean, canola, cotton, and sugarcane) and is specifically incorporated by reference for enabling the production of transgenic plants. Similar methods have been reported for many plant species, both dicots and monocots, including, among others, peanut (Cheng et al. (1996) Plant Cell Rep., 15: 653); asparagus (Bytebier et al. (1987) Proc. Natl. Acad. Sci. U.S.A., 84:5345); barley (Wan and Lemaux (1994) Plant Physiol., 104:37); rice (Toriyama et al. (1988) Bio/Technology, 6:10; Zhang et al. (1988) Plant Cell Rep., 7:379; wheat (Vasil et al. (1992) Bio/Technology, 10:667; Becker et al. (1994) Plant J., 5:299), alfalfa (Masoud et al. (1996) Transgen. Res., 5:313); and tomato (Sun et al. (2006) Plant Cell Physiol., 47:426-431). See also a description of vectors, transformation methods, and production of transformed *Arabidopsis thaliana* plants where transcription factors are constitutively expressed by a CaMV35S promoter, in U. S. Patent Application Publication 2003/0167537 A1, incorporated by reference. Transformation methods specifically useful for solanaceous plants are well known in the art. See, for example, publicly described transformation methods for tomato (Sharma et al. (2009), J. Biosci., 34:423-433), eggplant (Arpaia et al. (1997) Theor. Appl. Genet., 95:329-334), potato (Bannerjee et al. (2006) Plant Sci., 170:732-738; Chakravarty et al. (2007) Amer. J. Potato Res., 84:301-311; S. Millam "*Agrobacterium*-mediated transformation of potato." Chapter 19 (pp. 257-270), "Transgenic Crops of the World: Essential Protocols", Ian S. Curtis (editor), Springer, 2004), and peppers (Li et al. (2003) Plant Cell Reports, 21: 785-788). Stably transgenic potato, tomato, and eggplant have been commercially introduced in various regions; see, e. g., K. Redenbaugh et al. "Safety Assessment of Genetically Engineered Fruits and Vegetables: A Case Study of the FLAVR SAVR Tomato", CRC Press, Boca Raton, 1992, and the extensive publicly available documentation of commercial genetically modified crops in the GM Crop Database; see: CERA. (2012). GM Crop Database. Center for Environmental Risk Assessment (CERA), ILSI Research Foundation, Washington D.C., available electronically at cera-gmc.org/?action=gm_crop_database. Various methods of transformation of other plant species are well known in the art, see, for example, the encyclopedic reference, "Compendium of Transgenic Crop Plants", edited by Chittaranjan Kole and Timothy C. Hall, Blackwell Publishing Ltd., 2008; ISBN 978-1-405-16924-0 (available electronically at mrw.interscience.wiley.com/emrw/9781405181099/hpt/toc), which describes transformation procedures for cereals and forage grasses (rice, maize, wheat, barley, oat, sorghum, pearl millet, finger millet, cool-season forage grasses, and bahiagrass), oilseed crops (soybean, oilseed brassicas, sunflower, peanut, flax, sesame, and safflower), legume grains and forages (common bean, cowpea, pea, faba bean, lentil, tepary bean, Asiatic beans, pigeonpea, vetch, chickpea, lupin, alfalfa, and clovers), temperate fruits and nuts (apple, pear, peach, plums, berry crops, cherries, grapes, olive, almond, and Persian walnut), tropical and subtropical fruits and nuts (citrus, grapefruit, banana and plantain, pineapple, papaya, mango, avocado, kiwifruit, passionfruit, and persimmon), vegetable crops (tomato, eggplant, peppers, vegetable brassicas, radish, carrot, cucurbits, alliums, asparagus, and leafy vegetables), sugar, tuber, and fiber crops (sugarcane, sugar beet, stevia, potato, sweet potato, cassava, and cotton), plantation crops, ornamentals, and turf grasses (tobacco, coffee, cocoa, tea, rubber tree, medicinal plants, ornamentals, and turf grasses), and forest tree species.

Transformation methods to provide transgenic plant cells and transgenic plants containing stably integrated recombinant DNA are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos or parts of embryos, and gametic cells such as microspores, pollen, sperm, and egg cells. Any cell from which a fertile plant can be regenerated is contemplated as a useful recipient cell for practice of this invention. Callus can be initiated from various tissue sources, including, but not limited to, immature embryos or parts of embryos, seedling apical meristems, microspores, and the like. Those cells which are capable of proliferating as callus can serve as recipient cells for genetic transformation. Practical transformation methods and materials for making transgenic plants of this invention (e.g., various media and recipient target cells, transformation of immature embryos, and subsequent regeneration of fertile transgenic plants) are disclosed, for example, in U.S. Pat. Nos. 6,194,636 and 6,232,526 and U.S. Patent Application Publication 2004/0216189, which are specifically incorporated by reference.

In general transformation practice, DNA is introduced into only a small percentage of target cells in any one transformation experiment. Marker genes are generally used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the antibiotics or herbicides to which a plant cell is resistant can be a useful agent for selection. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the recombinant DNA. Commonly used selective marker genes include those conferring resistance to antibiotics such as kanamycin or paromomycin (nptll), hygromycin B (aph IV) and gentamycin (aac3 and aacC4) or resistance to herbicides such as glufosinate (bar or pat) and glyphosate (EPSPS). Examples of useful selective marker genes and selection agents are illustrated in U.S. Pat. Nos. 5,550,318, 5,633,435, 5,780,708, and 6,118,047, all of which are specifically incorporated by reference. Screenable markers or reporters, such as markers that provide an ability to visually identify transformants can also be employed. Examples of useful screenable markers include, for example, a gene expressing a protein that produces a detectable color by acting on a chromogenic substrate (e.g., beta glucuronidase (GUS) (uidA) or luciferase (luc)) or that itself is detectable, such as green fluorescent protein (GFP) (gfp) or an immunogenic molecule. Those of skill in the art will recognize that many other useful markers or reporters are available for use.

Detecting or measuring transcription of a recombinant DNA construct in a transgenic plant cell can be achieved by any suitable method, including protein detection methods (e.g., western blots, ELISAs, and other immunochemical methods), measurements of enzymatic activity, or nucleic acid detection methods (e.g., Southern blots, northern blots, PCR, RT-PCR, fluorescent in situ hybridization).

Other suitable methods for detecting or measuring transcription in a plant cell of a recombinant polynucleotide of this invention targetting a *Leptinotarsa* species target gene include measurement of any other trait that is a direct or proxy indication of the level of expression of the target gene in the *Leptinotarsa* species, relative to the level of expression observed in the absence of the recombinant polynucleotide, e.g., growth rates, mortality rates, or reproductive or recruitment rates of the *Leptinotarsa* species, or measurements of injury (e.g., root injury) or yield loss in a plant or field of plants infested by the *Leptinotarsa* species. In general, suitable methods for detecting or measuring transcription in a plant cell of a recombinant polynucleotide of interest include, e.g., gross or microscopic morphological traits, growth rates, yield, reproductive or recruitment rates, resistance to pests or pathogens, or resistance to biotic or abiotic stress (e.g., water deficit stress, salt stress, nutrient stress, heat or cold stress). Such methods can use direct measurements of a phenotypic trait or proxy assays (e.g., in plants, these assays include plant part assays such as leaf or root assays to determine tolerance of abiotic stress). Such methods include direct measurements of resistance to an invertebrate pest or pathogen (e.g., damage to plant tissues) or proxy assays (e.g., plant yield assays, or bioassays such as the Western corn rootworm (*Diabrotica virgifera virgifera* LeConte) larval bioassay described in International Patent Application Publication WO2005/110068 A2 and U.S. Patent Application Publication US 2006/0021087 A1, specifically incorporated by reference, or the soybean cyst nematode bioassay described by Steeves et al. (2006) *Funct. Plant Biol.,* 33:991-999, wherein cysts per plant, cysts per gram root, eggs per plant, eggs per gram root, and eggs per cyst are measured, or the Colorado potato beetle (*Leptinotarsa decemlineata*) bioassay described herein in the working Examples.

The recombinant DNA constructs of this invention can be stacked with other recombinant DNA for imparting additional traits (e.g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

Seeds of fertile transgenic plants can be harvested and used to grow progeny generations, including hybrid generations, of transgenic plants of this invention that include the recombinant DNA construct in their genome. Thus, in addition to direct transformation of a plant with a recombinant DNA construct of this invention, transgenic plants of this invention can be prepared by crossing a first plant having the recombinant DNA with a second plant lacking the construct. For example, the recombinant DNA can be introduced into a plant line that is amenable to transformation to produce a transgenic plant, which can be crossed with a second plant line to introgress the recombinant DNA into the resulting progeny. A transgenic plant of this invention can be crossed with a plant line having other recombinant DNA that confers one or more additional trait(s) (such as, but not limited to, herbicide resistance, pest or disease resistance, environmental stress resistance, modified nutrient content, and yield improvement) to produce progeny plants having recombinant DNA that confers both the desired target sequence expression behavior and the additional trait(s).

In such breeding for combining traits the transgenic plant donating the additional trait can be a male line (pollinator) and the transgenic plant carrying the base traits can be the female line. The progeny of this cross segregate such that some of the plant will carry the DNA for both parental traits and some will carry DNA for one parental trait; such plants can be identified by markers associated with parental recombinant DNA Progeny plants carrying DNA for both parental traits can be crossed back into the female parent line multiple times, e.g., usually 6 to 8 generations, to produce a homozygous progeny plant with substantially the same genotype as one original transgenic parental line as well as the recombinant DNA of the other transgenic parental line.

Yet another aspect of this invention is a transgenic plant grown from the transgenic seed (or in the case of potatoes, a transgenic seed potato) of this invention. This invention contemplates transgenic plants grown directly from transgenic seed containing the recombinant DNA as well as progeny generations of plants, including inbred or hybrid plant lines, made by crossing a transgenic plant grown directly from transgenic seed to a second plant not grown from the same transgenic seed. Crossing can include, for example, the following steps:

(a) plant seeds of the first parent plant (e.g., non-transgenic or a transgenic) and a second parent plant that is transgenic according to the invention;

(b) grow the seeds of the first and second parent plants into plants that bear flowers;

(c) pollinate a flower from the first parent with pollen from the second parent; and (d) harvest seeds produced on the parent plant bearing the fertilized flower.

It is often desirable to introgress recombinant DNA into elite varieties, e.g., by backcrossing, to transfer a specific desirable trait from one source to an inbred or other plant that lacks that trait. This can be accomplished, for example, by first crossing a superior inbred ("A") (recurrent parent) to a donor inbred ("B") (non-recurrent parent), which carries the appropriate gene(s) for the trait in question, for example, a construct prepared in accordance with the current invention. The progeny of this cross first are selected in the resultant progeny for the desired trait to be transferred from the non-recurrent parent "B", and then the selected progeny are mated back to the superior recurrent parent "A". After five or more backcross generations with selection for the desired trait, the progeny can be essentially hemizygous for loci controlling the characteristic being transferred, but are like the superior parent for most or almost all other genes. The last backcross generation would be selfed to give progeny which are pure breeding for the gene(s) being transferred, e.g., one or more transformation events.

Through a series of breeding manipulations, a selected DNA construct can be moved from one line into an entirely different line without the need for further recombinant manipulation. One can thus produce inbred plants which are true breeding for one or more DNA constructs. By crossing different inbred plants, one can produce a large number of different hybrids with different combinations of DNA constructs. In this way, plants can be produced which have the desirable agronomic properties frequently associated with hybrids ("hybrid vigor"), as well as the desirable characteristics imparted by one or more DNA constructs.

In certain transgenic plant cells and transgenic plants of this invention, it is sometimes desirable to concurrently express a gene of interest while also modulating expression of a *Leptinotarsa* target gene. Thus, in some embodiments, the transgenic plant contains recombinant DNA further comprising a gene expression element for expressing at least one gene of interest, and transcription of the recombinant DNA construct of this invention is effected with concurrent transcription of the gene expression element.

In some embodiments, the recombinant DNA constructs of this invention can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, papaya, avocado, and berries; plants grown for biomass or biofuel (for example, *Miscanthus* grasses, switchgrass, jatropha, oil palm, eukaryotic microalgae such as *Botryococcus braunii, Chlorella* spp., and *Dunaliella* spp., and eukaryotic macroalgae such as *Gracilaria* spp., and *Sargassum* spp.); and ornamental plants including ornamental flowering plants, ornamental trees and shrubs, ornamental groundcovers, and ornamental grasses.

This invention also provides commodity products produced from a transgenic plant cell, plant, or seed of this invention, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed of this invention. The detection of one or more of nucleic acid sequences of the recombinant DNA constructs of this invention in one or more commodity or commodity products contemplated herein is de facto evidence that the commodity or commodity product contains or is derived from a transgenic plant cell, plant, or seed of this invention.

Generally a transgenic plant having in its genome a recombinant DNA construct of this invention exhibits increased resistance to a *Leptinotarsa* species infestation. In various embodiments, for example, where the transgenic plant expresses a recombinant DNA construct of this invention that is stacked with other recombinant DNA for imparting additional traits, the transgenic plant has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the transgenic plant is characterized by: improved tolerance of abiotic stress (e.g., tolerance of water deficit or drought, heat, cold, non-optimal nutrient or salt levels, non-optimal light levels) or of biotic stress (e.g., crowding, allelopathy, or wounding); by a modified primary metabolite (e.g., fatty acid, oil, amino acid, protein, sugar, or carbohydrate) composition; a modified secondary metabolite (e.g., alkaloids, terpenoids, polyketides, non-ribosomal peptides, and secondary metabolites of mixed biosynthetic origin) composition; a modified trace element (e.g., iron, zinc), carotenoid (e.g., beta-carotene, lycopene, lutein, zeaxanthin, or other carotenoids and xanthophylls), or vitamin (e.g., tocopherols) composition; improved yield (e.g., improved yield under non-stress conditions or improved yield under biotic or abiotic stress); improved ability to use nitrogen, phosphate, or other nutrients; modified agronomic characteristics (e.g., delayed ripening;

delayed senescence; earlier or later maturity; improved shade tolerance; improved resistance to root or stalk lodging; improved resistance to "green snap" of stems; modified photoperiod response); modified growth or reproductive characteristics (e.g., intentional dwarfing; intentional male sterility, useful, e.g., in improved hybridization procedures; improved vegetative growth rate; improved germination; improved male or female fertility); improved harvest, storage, or processing quality (e.g., improved resistance to pests during storage, improved resistance to breakage, improved appeal to consumers); or any combination of these traits.

In another embodiment, transgenic seed, or seed produced by the transgenic plant, has modified primary metabolite (e.g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

Generally, screening a population of transgenic plants each regenerated from a transgenic plant cell is performed to identify transgenic plant cells that develop into transgenic plants having the desired trait. The transgenic plants are assayed to detect an enhanced trait, e.g., enhanced water use efficiency, enhanced cold tolerance, increased yield, enhanced nitrogen use efficiency, enhanced seed protein, and enhanced seed oil. Screening methods include direct screening for the trait in a greenhouse or field trial or screening for a surrogate trait. Such analyses are directed to detecting changes in the chemical composition, biomass, physiological properties, or morphology of the plant. Changes in chemical compositions such as nutritional composition of grain are detected by analysis of the seed composition and content of protein, free amino acids, oil, free fatty acids, starch, tocopherols, or other nutrients. Changes in growth or biomass characteristics are detected by measuring plant height, stem diameter, internode length, root and shoot dry weights, and (for grain-producing plants such as maize, rice, or wheat) ear or seed head length and diameter. Changes in physiological properties are identified by evaluating responses to stress conditions, e.g., assays under imposed stress conditions such as water deficit, nitrogen or phosphate deficiency, cold or hot growing conditions, pathogen or insect attack, light deficiency, or increased plant density. Other selection properties include days to flowering, days to pollen shed, days to fruit maturation, fruit or tuber quality or amount produced, days to silking in maize, leaf extension rate, chlorophyll content, leaf temperature, stand, seedling vigor, internode length, plant height, leaf number, leaf area, tillering, brace roots, staying green, stalk lodging, root lodging, plant health, fertility, green snap, and pest resistance. In addition, phenotypic characteristics of harvested fruit, seeds, or tubers can be evaluated; for example, in tomato and eggplant this can include the total number or weight of fruit harvested or the color, acidity, sugar content, or flavor of such fruit, and in potato this can include the number or total weight of tubers harvested and the quality of such tubers.

Specific assays with the compositions and methods of this invention can be carried out in solanaceous plants including potato, tomato, eggplant, and peppers, either as hybrids or inbreds; such assays are useful, e.g., for identifying or selecting plants with improved resistance to Colorado potato beetle (larvae or adults), for determining insecticidally effective amounts of a given composition, or for determining effective treatment regimes. Non-limiting examples of such assays include the following.

An in planta Colorado potato beetle (larvae or adults) assay is carried out in tomato plants with 6 replicates per treatment. Big Cherry tomato plants are seeded in Readi-Earth soil containing 6 pounds/cubic yard 14-14-14 fertilizer and maintained in a 27 degree Celsius, 50% relative humidity growth chamber for three weeks. On the day of the assay, double-stranded RNA is diluted into 25 milliliters of spray solution (20 millimolar sodium phosphate buffer (pH 6.8), optionally containing a surfactant, e.g., 0.2% Silwet L77) to the desired concentration, and applied to the plants using a track sprayer at a rate of 15 gallons per acre. A higher concentration (e.g., 100 micrograms/milliliter) can be used for initially assaying a polynucleotide for activity, and lower concentrations (e.g., between about 0.1 to about 1 microgram per milliliter) can be used in subsequent assays such as those for determining relative efficacy of various polynucleotides. Plants are caged individually with mesh sleeves, and infested with 12 neonatal *Leptinotarsa decemlineata* (Colorado potato beetle) larvae. Infested plants are incubated in the growth chamber (27 degrees Celsius, 50% relative humidity) for 12-14 days. At the end of this period, plants are evaluated for level of defoliation, rated as "percent control", and insects are collected from plants and soil to evaluate "percent viable insects recovered" and "average weight of viable insects recovered".

An in planta Colorado potato beetle (larvae or adults) assay is carried out in potato plants with 9 replicates per treatment. Cuttings are prepared from mature Atlantic potato plants by cutting the stem at an angle below the second node from the youngest growth. The cutting is dipped into rooting hormone (Rhizopon #1, 0.1% IBA) and immediately inserted into pre-wet Readi-Earth soil containing 6 pounds/cubic yard 14-14-14 fertilizer. Flats of cuttings are covered to decrease light exposure and placed in a sealed plastic bag to increase humidity. Over the next week, the cover is removed and flats are removed from the plastic bags. Plants that are 6-9 inches tall (usually 3 weeks from cutting date) are used in the assay. On the day of the assay, double-stranded RNA is diluted into 25 milliliters of spray solution (20 millimolar sodium phosphate buffer (pH 6.8), optionally containing a surfactant, e.g., 0.2% Silwet L77) to the desired concentration, and applied to the plants using a track sprayer at a rate of 15 gallons per acre. A higher concentration (e.g., 100 micrograms/milliliter) can be used for initially assaying a polynucleotide for activity, and lower concentrations (e.g., between about 0.1 to about 1 microgram per milliliter) can be used in subsequent assays such as those for determining relative efficacy of various polynucleotides. Plants are caged individually with mesh sleeves, and infested with 6 neonatal *Leptinotarsa decemlineata* (Colorado potato beetle) larvae. Infested plants are incubated in the growth chamber (27 degree Celsius, 50% relative humidity) for 12-14 days. At the end of this period, plants are evaluated for level of defoliation, rated as "percent control", and insects are collected from plants and soil to evaluate "percent viable insects recovered" and "average weight of viable insects recovered".

The following Examples are presented for the purposes of illustration and should not be construed as limitations.

EXAMPLES

Example 1: Generation of *Leptinotarsa* cDNA Library

A cDNA library was generated from *Leptinotarsa decemlineata* (Colorado potato beetle, "CPB") neonate larvae, as follows. Total RNA was isolated from 800 third instar *Leptinotarsa decemlineata* larvae (whole body) using an Ambion Totally RNA isolation kit (catalogue number AM1910, Life Technologies, Carlsbad, Calif.) with the optional LiCL precipitation procedure. PolyA RNA was isolated using Ambion MicroPoly(A) Purist (catalogue number AM1919, Life Technologies, Carlsbad, Calif.). Random primed cDNA synthesis was performed using a Superscript Double-Stranded cDNA synthesis kit (catalogue number 11917-010, Life Technologies, Carlsbad, Calif.) with a random hexamer kit (catalogue number 12328-032, Life Technologies, Carlsbad, Calif.). The cDNA library was obtained by high-throughput sequencing using commercially available 454 technology (454 Life Sciences, 15 Commercial St., Branford, Conn. 06405, USA), as described in Margulies et al. (2005) *Nature*, 437:376-380. This provided 1,446,014 reads (averaging ~350 base-pairs in length), which were supplemented with publicly available *Leptinotarsa decemlineata* sequence data from NCBI (including 8,835 expressed sequence tag sequences, 150 full-length cDNAs, 839,061 high-throughput DNA and RNA archived sequence reads) to provide a total of 2294087 combined reads. The combined sequence data were assembled into contigs de novo using the Newbler (version 2.3) software package (454 Life Sciences, 15 Commercial St., Branford, Conn. 06405, USA). Approximately 38,164 assembled contigs were identified from the sequence data.

Example 2: Selection of Low-Copy Target Genes

*Leptinotarsa* target gene sequences predicted to be effective targets for RNAi-mediated silencing were identified as follows. Low-copy genes, and in particular single-copy genes, were selected as targets for RNAi-mediated silencing as these genea are unlikely to have their function recapitulated by a paralogue. A public database of orthologous genes, OrthoDB6 (available at cegg.unige.ch/orthodb6 and described in Waterhouse et al. (2012) *Nucleic Acids Res.*, PMID:23180791; doi: 10.1093/nar/gks1116) was filtered to select a subset of 766 genes that were single-copy or low-copy in *Tribolium castaneum* (red flour beetle, a coleopteran species) as well as single-copy or low-copy in all available arthropod genomes in the database (at the time this application is filed 33 other arthropod genomes were available). *Tribolium castaneum* is a coleopteran species and is therefore closely related to *Leptinotarsa*, which makes it likely that a single-copy or low-copy gene present in the *Tribolium castaneum* genome database will also be a single-copy or low-copy gene in the *Leptinotarsa decemlineata* genome, at least for genes that have high sequence similarity between the two organisms. From the 38,164 unigenes obtained from the *Leptinotarsa decemlineata* (Colorado potato beetle, CPB) sequencing and assembly described in Example 1, a subset of 725 genes were identified using a translated nucleotide BLAST search (tblastx) as genes having high sequence similarity (significance or e-value of less than or equal to $1 \times 10^{-15}$) to the 766 single-copy or low-copy *Tribolium castaneum* genes in the OrthoDB database.

For sequence annotation, SmartBlast annotation was performed by using NCBI's Blastall 2.2.21 software to search *Leptinotarsa decemlineata* contigs against the publicly available uniref90.fasta database (See FTP at uniprot.org/downloads). The blast search was performed in blastx mode (translated *Leptinotarsa decemlineata* nucleotide queries searched against the uniref90 protein database). Only blast hits with an e-value less than or equal to 9e-9 were retained. For each *Leptinotarsa decemlineata* contig the description line from the uniref90 best hit was used as an annotation. When no SmartBlast hits were found, the sequence was subjected to a supplementary Pfam search. To accomplish this, the longest open reading frame (ORF) was identified for each *Leptinotarsa decemlineata* contig and used to query the publicly available Pfam-A database (See FTP at pfam.xfam.org) using the publicly available HMMER 3.0 software package (hmmer janelia.org/). *Leptinotarsa decemlineata* contigs with a Pfam hit with an e-value less than or equal to 1 e-5 were annotated with the protein family name and the Pfam identifier. *Leptinotarsa decemlineata* contigs with no SmartBlast or Pfam hit were annotated as "novel protein".

The 725 *Leptinotarsa decemlineata* genes identified as having high sequence similarity to single-copy or low-copy *Tribolium castaneum* genes as described above are provided as SEQ ID NOs:1-725, with each gene annotated based on sequence similarity to *Tribolium castaneum* and/or OrthoDB sequences, or by conserved Pfam domains. For each *Leptinotarsa decemlineata* gene, the homologous *Tribolium castaneum* gene is also identified in the annotation, together with the similarity e-value for each pair.

Example 3: Selection of *Leptinotarsa* Target Genes cDNA sequences corresponding to useful target genes for controlling *Leptinotarsa* species by RNAi-mediated silencing were selected from the sequences obtained from the *Leptinotarsa decemlineata* (Colorado potato beetle, CPB) sequencing and assembly described in Example 1. This subset of cDNA sequences or target genes is provided in SEQ ID NOs:726-830. It is recognized that analogous sequences can be obtained from any other *Leptinotarsa* species referred to herein.

Example 4: Selection of Polynucleotide Triggers by "Tiling"

One non-limiting example of a method for selecting a polynucleotide trigger for expression in a transgenic plant or use in a composition for topical application to the surface of a transgenic or non-transgenic plant involves the mapping of efficacious polynucleotide sequences (or segments of sequences) using a whole-gene (or full-length reference sequence) tiling array approach. Sequences selected from SEQ ID NOs:1-725 and SEQ ID NOs:726-830 and SEQ ID NOs:1087-1094 are divided into "tiling sequences" or segments of 200-300 contiguous nucleotides along the entire length of the selected target sequence. The tiling sequences can be designed to be contiguous segments of the selected sequence with no overlap or to overlap about 18, 19, 20, 21, 22, 23, 24 or 25 nucleotides in adjacent segments of the selected sequence. Polynucleotide triggers corresponding to each 200-300 nucleotide tiling sequence (in sense, anti-sense, or both sense and anti-sense orientation) are synthesized for efficacy screening.

The polynucleotide triggers are tested by any convenient means for efficacy in silencing the *Leptinotarsa* species target gene. An example of a suitable test is a diet bioassay such as that described in Examples 5 and 6. Another suitable test involves the topical application of the polynucleotide triggers either directly to *Leptinotarsa* individuals or to the surface of a plant to be protected from a *Leptinotarsa* species infestation. One desired result of treatment with a polynucleotide trigger is prevention or control of a *Leptinotarsa* species infestation, e.g., by inducing in a *Leptinotarsa* insect a physiological or behavioural change such as, but not limited to, growth stunting, increased mortality, decrease in reproductive capacity, decrease in or cessation of feeding behavior or movement, or decrease in or cessation of metamorphosis stage development. Another desired result of treatment with a polynucleotide trigger is provision of a solanaceous plant that exhibits improved resistance to a Leptinotarsa species infestation, such as a potato, tomato, eggplant, or pepper plant that exhibits improved resistance to an infestation by Leptinotarsa decemlineata (Colorado potato beetle, CPB) or other Leptinotarsa species. Polynucleotide tiggers may be screened in sets. For example, sets of five individual polynucleotide tiggers are pooled into a single polynucleotide composition and topically applied to plants. Those sets showing better efficacy are then re-screened by testing the individual component polynucleotide tiggers for efficacy.

The tiling procedure can be repeated, if desired. A polynucleotide trigger found to provide desired activity can itself be tiled. The parent polynucleotide trigger is divided into smaller overlapping or non-overlapping segments along the length of the parent polynucleotide trigger. For example, the parent polynucleotide trigger is divided into segments of 50-60 nucleotides in length along the entire length of the parent polynucleotide trigger. Polynucleotide triggers corresponding to each 50-60 nucleotide tiling sequence (in sense, anti-sense, or both sense and anti-sense orientation) are synthesized for efficacy screening. Additional rounds of tiling analysis can be carried out, where triggers as short as 18, 19, 20, 21, 22, 23, 24, or 25 nucleotides are tested.

Effective polynucleotide triggers of any size are used to make a composition for topical application or a recombinant DNA construct useful for making a transgenic plant.

Example 5

This example illustrates a non-limiting assay useful for evaluating the *Leptinotarsa*-controlling efficacy of polynucleotide triggers. More specifically, this example illustrates double-stranded RNA triggers comprising a nucleotide sequence that is complementary to at least 21 contiguous nucleotides of a *Leptinotarsa* target gene (e.g., a target gene selected from the Target Gene Sequences Group, or having a DNA sequence selected from the group consisting of: SEQ ID NOs:1-725 and SEQ ID NOs:726-830 and SEQ ID NOs:1087-1094, or the DNA complement thereof), and a bioassay useful for evaluating the *Leptinotarsa*-controlling efficacy of these dsRNA triggers.

Triggers of between about 50 to about 500 base-pairs (more specifically, of between about 100 to about 450 base-pairs) in length were designed for *Leptinotarsa* target genes (see Examples 2 and 3). Blunt-ended double-stranded RNAs (dsRNAs) with the anti-sense strand sequences provided in SEQ ID NOs: 831-1085 were manufactured for the target genes listed in Table 1.

The dsRNA triggers (Table 1) for suppressing the *Leptinotarsa* target genes were tested using the following methodology to assay mortality or stunting of *Leptinotarsa decemlineata* larvae due to contact with or ingestion of the polynucleotide triggers. Bioassays with the Colorado potato beetle (CPB), *Leptinotarsa decemlineata*, were conducted using an artificial diet consisting of 13.2 grams/liter agar (Serva 11393), 140.3 grams/liter Bio-Serve pre-mix (F9380B), 5 milliliters/liter KOH (18.3% w/w), and 1.25 milliliters/liter formalin (37%). The diet was dispensed in 200 microliter aliquots into 96-well plates and dried briefly prior to sample application. Twenty microliters of test sample were applied per well, with sterile water serving as the untreated control (UTC). Plates were allowed to dry before adding insect larvae. One neonate CPB larva was added per well with a fine paintbrush. Plates were sealed with Mylar and ventilated using an insect pin. Thirty-two larvae were tested per treatment. The bioassay plates were incubated at 27 degrees Celsius, 60% relative humidity, in complete darkness for 10-12 days. The plates were scored for larval stunting and mortality. Data was analyzed using JMP©4 statistical software (SAS Institute, 1995) and a full factorial ANOVA was conducted with a Dunnet's test to look for treatment effects compared to the untreated control ($P<0.05$). A Tukey-Kramer post hoc test was performed to compare all pairs of the treatments ($P<0.05$). Results are provided in Table 1.

TABLE 1

| SEQ ID NO.* | Target Gene | SEQ ID NO. OF TARGET GENE | CPB Diet Bioassay Results** | dsRNA concentration (ppm) | Exon No. |
|---|---|---|---|---|---|
| 831 | 26S proteasome non-ATPase regulatory subunit 1 | 825 | (+) | 0.1 | 1 |
| 832 | 26S proteasome non-ATPase regulatory subunit 1 | 825 | (−) | 0.1 | 1 |
| 833 | 26S proteasome non-ATPase regulatory subunit 1 | 825 | (−) | 0.1 | 1 |
| 834 | 26S proteasome non-ATPase regulatory subunit 1 | 825 | (−) | 0.1 | 1 |
| 835 | 26S proteasome non-ATPase regulatory subunit 1 | 825 | (−) | 0.1 | 2 |
| 836 | Actin | 821 | (−) | 0.1 | 1 |
| 837 | Actin | 821 | (−) | 0.1 | 1 |
| 838 | Actin | 821 | (−) | 0.1 | 1 |
| 839 | Actin | 821 | (−) | 0.1 | 1 |
| 840 | Actin | 821 | (−) | 0.1 | 1 |
| 841 | Coatomer subunit beta | 822 | (−) | 0.1 | 1 |
| 842 | Coatomer subunit beta | 822 | (+) | 0.1 | 1 |
| 843 | Coatomer subunit beta | 822 | NT | 0.1 | 1 |
| 844 | Coatomer subunit beta | 822 | NT | 0.1 | 1 |
| 845 | Coatomer subunit beta | 822 | (−) | 0.1 | 1 |
| 846 | 26S proteasome non-ATPase regulatory subunit 2 | 805 | (−) | 0.1 | 1 |
| 847 | 26S proteasome non-ATPase regulatory subunit 2 | 805 | (−) | 0.1 | 1 |
| 848 | 26S proteasome non-ATPase regulatory subunit 2 | 805 | (−) | 0.1 | 1 |
| 849 | 26S proteasome non-ATPase regulatory subunit 2 | 805 | (+) | 0.1 | 1 |
| 850 | 26S proteasome non-ATPase regulatory subunit 2 | 805 | (−) | 0.1 | 2? |
| 851 | 26S proteasome non-ATPase regulatory subunit 12 | 806 | (−) | 0.1 | 1 |
| 852 | 26S proteasome non-ATPase regulatory subunit 12 | 806 | (−) | 0.1 | 1 |
| 853 | 26S proteasome non-ATPase regulatory subunit 12 | 806 | NT | 0.1 | 2? |
| 854 | 26S proteasome non-ATPase regulatory subunit 12 | 806 | NT | 0.1 | 1 |

TABLE 1-continued

| SEQ ID NO.* | Target Gene | SEQ ID NO. OF TARGET GENE | CPB Diet Bioassay Results** | dsRNA concentration (ppm) | Exon No. |
|---|---|---|---|---|---|
| 855 | 26S proteasome non-ATPase regulatory subunit 12 | 806 | NT | 0.1 | 1 |
| 856 | Probable 26S proteasome non-ATPase regulatory subunit 3 | 807 | (−) | 0.1 | 1 |
| 857 | Probable 26S proteasome non-ATPase regulatory subunit 3 | 807 | (−) | 0.1 | 1 |
| 858 | Probable 26S proteasome non-ATPase regulatory subunit 3 | 807 | NT | 0.1 | 1 |
| 859 | Probable 26S proteasome non-ATPase regulatory subunit 3 | 807 | NT | 0.1 | 1 |
| 860 | Probable 26S proteasome non-ATPase regulatory subunit 3 | 807 | NT | 0.1 | 1 |
| 861 | 26S proteasome non-ATPase regulatory subunit 7 | 808 | (−) | 0.1 | 1 |
| 862 | 26S proteasome non-ATPase regulatory subunit 7 | 808 | (−) | 0.1 | 1 |
| 863 | 26S proteasome non-ATPase regulatory subunit 7 | 808 | NT | 0.1 | 1 |
| 864 | 26S proteasome non-ATPase regulatory subunit 7 | 808 | NT | 0.1 | 1 |
| 865 | 26S proteasome non-ATPase regulatory subunit 7 | 808 | NT | 0.1 | 1 |
| 866 | 26S proteasome non-ATPase regulatory subunit 2 | 809 | (−) | 0.1 | 1 |
| 867 | 26S proteasome non-ATPase regulatory subunit 2 | 809 | (−) | 0.1 | 2? |
| 868 | 26S proteasome non-ATPase regulatory subunit 2 | 809 | (−) | 0.1 | 2 |
| 869 | 26S proteasome non-ATPase regulatory subunit 2 | 809 | (−) | 0.1 | 1 |
| 870 | 26S proteasome non-ATPase regulatory subunit 2 | 809 | (−) | 0.1 | 1 |
| 871 | 26S proteasome non-ATPase regulatory subunit 4 | 810 | (−) | 0.1 | 1 |
| 872 | 26S proteasome non-ATPase regulatory subunit 4 | 810 | NT | 0.1 | 2 |
| 873 | 26S proteasome non-ATPase regulatory subunit 4 | 810 | NT | 0.1 | 1 |
| 874 | 26S proteasome non-ATPase regulatory subunit 4 | 810 | NT | 0.1 | 1 |
| 875 | 26S proteasome non-ATPase regulatory subunit 4 | 810 | NT | 0.1 | 1 |
| 876 | 26S protease regulatory subunit 8 | 811 | NT | 0.1 | 1 |
| 877 | 26S protease regulatory subunit 8 | 811 | NT | 0.1 | 1 |
| 878 | 26S protease regulatory subunit 8 | 811 | NT | 0.1 | 2? |
| 879 | 26S protease regulatory subunit 8 | 811 | (−) | 0.1 | 1 |
| 880 | 26S protease regulatory subunit 8 | 811 | (−) | 0.1 | 1 |
| 881 | 26S proteasome non-ATPase regulatory subunit 13 | 812 | NT | 0.1 | 2 |
| 882 | 26S proteasome non-ATPase regulatory subunit 13 | 812 | NT | 0.1 | 1 |
| 883 | 26S proteasome non-ATPase regulatory subunit 13 | 812 | (−) | 0.1 | 1 |
| 884 | 26S proteasome non-ATPase regulatory subunit 13 | 812 | (−) | 0.1 | 1 |
| 885 | 26S proteasome non-ATPase regulatory subunit 13 | 812 | (−) | 0.1 | 1 |
| 886 | Putative uncharacterized protein | 813 | NT | 0.1 | 1 |
| 887 | Putative uncharacterized protein | 813 | NT | 0.1 | 1 |
| 888 | Putative uncharacterized protein | 813 | (−) | 0.1 | 1 |
| 889 | ADP-ribosylation factor GTPase-activating protein, putative | 814 | NT | 0.1 | 1 |
| 890 | ADP-ribosylation factor GTPase-activating protein, putative | 814 | NT | 0.1 | 1 |
| 891 | ADP-ribosylation factor GTPase-activating protein, putative | 814 | (−) | 0.1 | 1 |
| 892 | ADP-ribosylation factor GTPase-activating protein, putative | 814 | (−) | 0.1 | 1 |
| 893 | Golgi-specific brefeldin A-resistance guanine nucleotide exchange factor, putative | 815 | NT | 0.1 | 1 |
| 894 | Golgi-specific brefeldin A-resistance guanine nucleotide exchange factor, putative | 815 | NT | 0.1 | 1 |
| 895 | Golgi-specific brefeldin A-resistance guanine nucleotide exchange factor, putative | 815 | NT | 0.1 | 1 |
| 896 | Golgi-specific brefeldin A-resistance guanine nucleotide exchange factor, putative | 815 | NT | 0.1 | 1 |
| 897 | Golgi-specific brefeldin A-resistance guanine nucleotide exchange factor, putative | 815 | NT | 0.1 | 2? |
| 898 | Sec24 protein, putative | 816 | (+) | 0.1 | 2 |
| 899 | Sec24 protein, putative | 816 | (−) | 0.1 | 2? |
| 900 | Sec24 protein, putative | 816 | (−) | 0.1 | 2? |
| 901 | Sec24 protein, putative | 816 | (−) | 0.1 | 2? |
| 902 | Sec24 protein, putative | 816 | (−) | 0.1 | 1 |
| 903 | Protein transport protein Sec24B | 817 | (−) | 0.1 | 1 |
| 904 | Protein transport protein Sec24B | 817 | (−) | 0.1 | 1 |
| 905 | Protein transport protein Sec24B | 817 | (−) | 0.1 | 1 |
| 906 | Protein transport protein Sec24B | 817 | (−) | 0.1 | 1 |
| 907 | Protein transport protein Sec24B | 817 | (−) | 0.1 | 1 |
| 908 | Protein transport protein sec31A | 818 | (−) | 0.1 | 1 |
| 909 | Protein transport protein sec31A | 818 | (−) | 0.1 | 1 |
| 910 | Protein transport protein sec31A | 818 | (+) | 0.1 | 1 |
| 911 | Protein transport protein sec31A | 818 | (−) | 0.1 | 2? |
| 912 | Protein transport protein sec31A | 818 | (−) | 0.1 | 1 |
| 913 | GTP-binding protein SAR1B | 819 | (−) | 0.1 | 1 |
| 914 | GTP-binding protein SAR1B | 819 | (−) | 0.1 | 1 |
| 915 | GTP-binding protein SAR1B | 819 | NT | 0.1 | 2 |
| 916 | GTP-binding protein SAR1B | 819 | NT | 0.1 | 1 |
| 917 | GTP-binding protein SAR1B | 819 | NT | 0.1 | 1 |
| 918 | Protein transport protein sec13 | 820 | (−) | 0.1 | 2 |
| 919 | Protein transport protein sec13 | 820 | (−) | 0.1 | 1 |
| 920 | Protein transport protein sec13 | 820 | (−) | 0.1 | 1 |
| 921 | Protein transport protein sec13 | 820 | (−) | 0.1 | 1 |
| 922 | Ribosomal protein L13A | 741 | NT | 1.0 | 2 |
| 923 | Ribosomal protein L13A | 741 | NT | 1.0 | 2 |
| 924 | 60S ribosomal protein L5 | 728 | NT | 1.0 | 2 |

TABLE 1-continued

| SEQ ID NO.* | Target Gene | SEQ ID NO. OF TARGET GENE | CPB Diet Bioassay Results** | dsRNA concentration (ppm) | Exon No. |
|---|---|---|---|---|---|
| 925 | 60S ribosomal protein L5 | 728 | (+) | 1.0 | 2? |
| 926 | Ribosomal protein S7 | 776 | NT | 1.0 | 1 |
| 927 | Ribosomal protein S7 | 776 | (−) | 1.0 | 1 |
| 928 | Ribosomal protein L9 | 735 | (+) | 1.0 | 2 |
| 929 | Ribosomal protein L9 | 735 | NT | 1.0 | 1 |
| 930 | Ribosomal protein L3 | 726 | NT | 1.0 | 2 |
| 931 | Ribosomal protein L3 | 726 | (+) | 1.0 | 2 |
| 932 | 60S ribosomal protein L32 | 755 | (+) | 1.0 | 3 |
| 933 | Ribosomal protein L8 | 734 | NT | 1.0 | 2 |
| 934 | Ribosomal protein L8 | 734 | NT | 1.0 | 2 |
| 935 | Ribosomal protein S15 | 785 | NT | 1.0 | 2 |
| 936 | Ribosomal protein S15 | 785 | NT | 1.0 | 2 |
| 937 | Ribosomal protein L7A | 732 | (+) | 1.0 | 3 |
| 938 | Ribosomal protein L7A | 732 | (+) | 1.0 | 3 |
| 939 | 40S ribosomal protein S14 | 784 | NT | 1.0 | 2 |
| 940 | 40S ribosomal protein S14 | 784 | (+) | 1.0 | 2 |
| 941 | 40S ribosomal protein S24 | 796 | (+) | 1.0 | 2? |
| 942 | 60S ribosomal protein L10A | 737 | (+) | 1.0 | 1 |
| 943 | Ribosomal protein L13 | 740 | (+) | 1.0 | 1 |
| 944 | Ribosomal protein L13 | 740 | (+) | 1.0 | 1 |
| 945 | Ribosomal protein S13 | 783 | (+) | 1.0 | 3 |
| 946 | Ribosomal protein S13 | 783 | NT | 1.0 | 2 |
| 947 | Ribosomal protein L4e | 727 | (+) | 1.0 | 3 |
| 948 | Ribosomal protein L4e | 727 | (+) | 1.0 | 2 |
| 949 | Ribosomal protein S30 | 803 | (+) | 1.0 | 2 |
| 950 | Ribosomal protein S30 | 803 | (+) | 1.0 | 2 |
| 951 | Ribosomal protein L26 | 749 | (+) | 1.0 | 2? |
| 952 | Ribosomal protein L26 | 749 | (+) | 1.0 | 2? |
| 953 | Ribosomal protein L31 | 754 | NT | 1.0 | 3 |
| 954 | 60S Ribosomal protein L10 | 736 | NT | 1.0 | 2 |
| 955 | 60S Ribosomal protein L10 | 736 | (+) | 1.0 | 2 |
| 956 | Ribosomal protein S4 | 772 | (+) | 1.0 | 3 |
| 957 | Ribosomal protein S4 | 772 | (+) | 1.0 | 2 |
| 958 | Ribosomal protein L11e | 738 | (+) | 1.0 | 2 |
| 959 | Ribosomal protein S6 | 774 | (−) | 1.0 | 1 |
| 960 | Ribosomal protein S11 | 782 | (+) | 1.0 | 3 |
| 961 | Ribosomal protein S11 | 782 | (+) | 1.0 | 3 |
| 962 | Ribosomal protein S11 | 781 | NT | 1.0 | 3 |
| 963 | Ribosomal protein S11 | 781 | NT | 1.0 | 3 |
| 964 | Ribosomal protein L12e | 739 | (+) | 1.0 | 2 |
| 965 | Ribosomal protein L12e | 739 | NT | 1.0 | 2 |
| 966 | Ribosomal protein S5 | 773 | (+) | 1.0 | 2 |
| 967 | Ribosomal protein S5 | 773 | (+) | 1.0 | 3 |
| 968 | Ribosomal protein S18 | 790 | (+) | 1.0 | 2 |
| 969 | Ribosomal protein S18 | 790 | (+) | 1.0 | 2 |
| 970 | Ribosomal protein L23A | 747 | (+) | 1.0 | 2 |
| 971 | Ribosomal protein L23A | 747 | (+) | 1.0 | 2 |
| 972 | Ribosomal protein L35A | 759 | NT | 1.0 | 1 |
| 973 | Ribosomal protein L35A | 759 | (+) | 1.0 | 2 |
| 974 | Ribosomal protein L21 | 746 | NT | 1.0 | 2? |
| 975 | Ribosomal protein L21 | 746 | NT | 1.0 | 2? |
| 976 | Ribosomal protein L21 | 745 | (+) | 1.0 | 1 |
| 977 | Ribosomal protein L21 | 745 | (−) | 1.0 | 2? |
| 978 | Ribosomal protein S8 | 777 | (+) | 1.0 | 2 |
| 979 | Ribosomal protein S8 | 777 | (+) | 1.0 | 3 |
| 980 | Ribosomal protein S16 | 788 | NT | 1.0 | 1 |
| 981 | Ribosomal protein S16 | 799 | NT | 1.0 | 2 |
| 982 | Ribosomal protein L18Ae | 744 | (+) | 1.0 | 2 |
| 983 | Ribosomal protein S6 | 775 | (+) | 1.0 | 1 |
| 984 | Ribosomal protein S3 | 768 | NT | 1.0 | 2 |
| 985 | Ribosomal protein S3 | 768 | (+) | 1.0 | 2 |
| 986 | Ribosomal protein S17 | 789 | NT | 1.0 | 2 |
| 987 | Ribosomal protein S15A | 786 | (+) | 1.0 | 2 |
| 988 | Ribosomal protein L7 | 730 | (+) | 1.0 | 2? |
| 989 | Ribosomal protein L7 | 730 | (+) | 1.0 | 2 |
| 990 | Ribosomal protein S4 | 771 | NT | 1.0 | 2 |
| 991 | Ribosomal protein S4 | 771 | (+) | 1.0 | 2 |
| 992 | 40S ribosomal protein S3A | 769 | (+) | 1.0 | 1 |
| 993 | 40S ribosomal protein S3A | 769 | NT | 1.0 | 1 |

TABLE 1-continued

| SEQ ID NO.* | Target Gene | SEQ ID NO. OF TARGET GENE | CPB Diet Bioassay Results** | dsRNA concentration (ppm) | Exon No. |
|---|---|---|---|---|---|
| 994 | Ribosomal protein L36 | 760 | (+) | 1.0 | 1 |
| 995 | Ribosomal protein L37 | 762 | (+) | 1.0 | 2 |
| 996 | Ribosomal protein L37 | 763 | (+) | 1.0 | 2 |
| 997 | Ribosomal protein S19 | 792 | (+) | 1.0 | 1 |
| 998 | Ribosomal protein S19 | 792 | NT | 1.0 | 1 |
| 999 | Ribosomal protein S19 | 792 | (+) | 1.0 | 1 |
| 1000 | Ribosomal protein S20 | 794 | NT | 1.0 | 1 |
| 1001 | Ribosomal protein L15 | 743 | NT | 1.0 | 2 |
| 1002 | Ribosomal protein L35A | 758 | NT | 1.0 | 1 |
| 1003 | Ribosomal protein L35A | 758 | NT | 1.0 | 1 |
| 1004 | 40S ribosomal protein S21 | 795 | NT | 1.0 | 3 |
| 1005 | Ribosomal protein S29 | 802 | NT | 1.0 | 1 |
| 1006 | Ribosomal protein S8 | 778 | (+) | 1.0 | 1 |
| 1007 | 40S ribosomal protein S3A | 770 | (+) | 1.0 | 1 |
| 1008 | Ribosomal protein L24 | 748 | (+) | 1.0 | 2 |
| 1009 | Ribosomal protein S16 | 787 | (+) | 1.0 | 2 |
| 1010 | Ribosomal protein L7A | 733 | (+) | 1.0 | 1 |
| 1011 | 40S ribosomal protein S9 | 780 | NT | 1.0 | 2 |
| 1012 | 40S ribosomal protein SA | 804 | NT | 1.0 | 1 |
| 1013 | 40S ribosomal protein SA | 804 | (+) | 1.0 | 1 |
| 1014 | Ribosomal protein L37Ae | 764 | (−) | 1.0 | 2? |
| 1015 | 60S Ribosomal protein L23 | 797 | NT | 1.0 | 1 |
| 1016 | Ribosomal protein L7 | 731 | NT | 1.0 | 2 |
| 1017 | Ribosomal protein L36 | 761 | NT | 1.0 | 1 |
| 1018 | 40S ribosomal protein S9 | 779 | (+) | 1.0 | 2? |
| 1019 | Ribosomal protein S26 | 798 | (+) | 1.0 | 3 |
| 1020 | Ribosomal protein L34A | 756 | (+) | 1.0 | 2 |
| 1021 | Ribosomal protein L27Ae | 751 | NT | 1.0 | 1 |
| 1022 | Ribosomal protein L27Ae | 751 | (+) | 1.0 | 1 |
| 1023 | 40S ribosomal protein S28 | 801 | (−) | 1.0 | 2? |
| 1024 | Ribosomal protein L29 | 753 | (−) | 1.0 | 3 |
| 1025 | Ribosomal protein L28 | 752 | (+) | 1.0 | 4 |
| 1026 | Ribosomal protein L28 | 752 | NT | 1.0 | 4 |
| 1027 | Ribosomal biogenesis protein RLP24 | 765 | NT | 1.0 | 2 |
| 1028 | Ribosomal biogenesis protein RLP24 | 765 | (−) | 1.0 | 1 |
| 1029 | Ribosomal protein L27 | 750 | (+) | 1.0 | 2 |
| 1030 | Ribosomal protein L27 | 750 | (+) | 1.0 | 2 |
| 1031 | 39S ribosomal protein L13 | 766 | (−) | 1.0 | 3 |
| 1032 | 39S ribosomal protein L13 | 766 | (−) | 1.0 | 3 |
| 1033 | Ribosomal protein S2 | 767 | (+) | 1.0 | 1 |
| 1034 | 40S ribosomal protein S28 | 800 | (−) | 1.0 | 2? |
| 1035 | Ribosomal protein L14 | 742 | (+) | 1.0 | 2 |
| 1036 | Ribosomal protein L6 | 729 | (+) | 1.0 | 2 |
| 1037 | Coatomer subunit beta | 822 | (+) | 1.0 | 2 |
| 1038 | Coatomer subunit gamma | 828 | (+) | 1.0 | 2 |
| 1039 | Myosin Vila | 824 | (+) | 1.0 | 2 |
| 1040 | Myosin Vila | 823 | (+) | 1.0 | 1 |
| 1041 | Actin | 821 | (+) | 1.0 | 1 |
| 1042 | 26S proteasome non-ATPase regulatory subunit 1 | 826 | (+) | 1.0 | 2 |
| 1043 | 26S proteasome non-ATPase regulatory subunit 1 | 825 | (+) | 1.0 | 2 |
| 1044 | crooked neck | 830 | NT | 1.0 | 1 |
| 1045 | crooked neck | 829 | (+) | 1.0 | 2 |
| 1046 | Predicted putative protein | 827 | (+) | 1.0 | 2 |
| 1047 | 26S proteasome non-ATPase regulatory subunit 2 | 805 | (+) | 1.0 | 2 |
| 1048 | 26S proteasome non-ATPase regulatory subunit, putative | 806 | (−) | 1.0 | 2 |
| 1049 | Probable 26S proteasome non-ATPase regulatory subunit 3 | 807 | (+) | 1.0 | 1 |
| 1050 | 26S proteasome non-ATPase regulatory subunit 7 | 808 | (+) | 1.0 | 2 |
| 1051 | 26S proteasome non-ATPase regulatory subunit 2 | 809 | NT | 1.0 | 2 |
| 1052 | 26S proteasome non-ATPase regulatory subunit 4 | 810 | (−) | 1.0 | 3 |
| 1053 | 26S protease regulatory subunit 8 | 811 | (+) | 1.0 | 3 |
| 1054 | 26S proteasome non-ATPase regulatory subunit 13 | 812 | (+) | 1.0 | 3 |
| 1055 | Putative uncharacterized protein | 813 | (−) | 1.0 | 2 |
| 1056 | ADP-ribosylation factor GTPase-activating protein, putative | 814 | (−) | 1.0 | 2 |
| 1057 | Golgi-specific brefeldin A-resistance guanine nucleotide exchange factor, putative | 815 | (−) | 1.0 | 2? |
| 1058 | Sec24 protein, putative | 816 | (+) | 1.0 | 2 |
| 1059 | Protein transport protein Sec24B | 817 | (−) | 1.0 | 1 |
| 1060 | Protein transport protein sec31A | 818 | (+) | 1.0 | 2 |
| 1061 | GTP-binding protein SAR1B | 819 | (+) | 1.0 | 2 |

TABLE 1-continued

| SEQ ID NO.* | Target Gene | SEQ ID NO. OF TARGET GENE | CPB Diet Bioassay Results** | dsRNA concentration (ppm) | Exon No. |
|---|---|---|---|---|---|
| 1062 | Protein transport protein sec13 | 820 | (−) | 1.0 | 2? |
| 1063 | Sec24B protein | 817 | (−) | 1.0 | 1 |
| 1064 | Coatomer subunit beta | 822 | (+) | 1.0 | 2 |
| 1065 | Coatomer subunit gamma | 828 | (+) | 1.0 | 2 |
| 1066 | Myosin Vila | 824 | (+) | 1.0 | 2 |
| 1067 | Myosin Vila | 823 | (+) | 1.0 | 2 |
| 1068 | Actin | 821 | (+) | 1.0 | 1 |
| 1069 | 26S proteasome non-ATPase regulatory subunit 1 | 825 | NT | 1.0 | 2 |
| 1070 | Crooked neck | 829 | (+) | 1.0 | 2 |
| 1071 | 26S proteasome non-ATPase regulatory subunit 2 | 805 | (−) | 1.0 | 2 |
| 1072 | 26S proteasome non-ATPase regulatory subunit 12 | 806 | (−) | 1.0 | 2 |
| 1073 | Probable 26S proteasome non-ATPase regulatory subunit 3 | 807 | (+) | 1.0 | 1 |
| 1074 | 26S proteasome non-ATPase regulatory subunit 7 | 808 | (+) | 1.0 | 2 |
| 1075 | 26S proteasome non-ATPase regulatory subunit 2 | 809 | (+) | 1.0 | 2 |
| 1076 | 26S proteasome non-ATPase regulatory subunit 4 | 810 | (−) | 1.0 | 2 |
| 1077 | 26S protease regulatory subunit 8 | 811 | (+) | 1.0 | 3 |
| 1078 | 26S proteasome non-ATPase regulatory subunit 13 | 812 | (+) | 1.0 | 3 |
| 1079 | ADP-ribosylation factor GTPase-activating protein, putative | 814 | (−) | 1.0 | 2 |
| 1080 | Golgi-specific brefeldin A-resistance guanine nucleotide exchange factor, putative | 815 | (+) | 1.0 | 1 |
| 1081 | Sec24 protein, putative | 816 | (+) | 1.0 | 1 |
| 1082 | Protein transport protein Sec24B | 817 | (+) | 1.0 | 1 |
| 1083 | Protein transport protein sec31A | 818 | (−) | 1.0 | 1 |
| 1084 | GTP-binding protein SAR1B | 819 | (+) | 1.0 | 1 |
| 1085 | Protein transport protein sec13 | 820 | (+) | 1.0 | 1 |

*sequence of anti-sense strand of the dsRNA trigger
**(+) significant stunting or mortality compared with water-treated control; (−) no significant stunting or mortality compared with water-treated control; NT = either (1) trigger was not tested, or (2) both of the following occurred: the sample did not provide significant stunting/mortality and the positive control did not provide significant stunting/mortality in that test. Positive control used in this assay was the dsRNA trigger targetting beta coatomer and having the sense strand sequence of SEQ ID NO:1086, previously disclosed as SEQ ID NO:880 in U.S. Pat. No. 7,943,819.

Where available genomic sequence data permitted, the number of exons spanned by a given trigger sequence was determined and is provided in Table 1: "1" indicates the trigger sequence appears to be contained in a single contiguous genomic locus; "2?" indicates that the full length of the trigger did not align to the genome, with at least 40 base-pairs missing, which may indicate incompleteness of the available genomic sequence data.

Additional cDNA sequences encoding subunits of a *Leptinotarsa decemlineata* (Colorado potato beetle, CPB) exocyst complex were identified from a separate sequencing and assembly project as *Leptinotarsa* target genes. These *Leptinotarsa* exocyst target genes, SEQ ID NOs:1087-1094, are useful in designing polynucleotide triggers comprising at least 21 contiguous nucleotides complementary to an exocyst target gene and useful for controlling *Leptinotarsa* species infestations, and in making transgenic plants expressing such polynucleotide triggers for resistance to *Leptinotarsa* species infestations.

Triggers of between about 50 to about 500 base-pairs (more specifically, of between about 100 to about 450 base-pairs) in length are designed for each of the *Leptinotarsa* exocyst target genes (SEQ ID NOs:1087-1094) as described in Example 4. These triggers are tested using the same methodology as that described above for the polynucleotides in Table 1.

In a non-limiting example, a polynucleotide trigger, designed to target the *Leptinotarsa decemlineata* Exo70 gene (SEQ ID NO:1093), was produced as a blunt-ended double-stranded RNA having the anti-sense strand sequence of SEQ ID NO:1095. This trigger gave significant stunting and significant mortality at both concentrations tested, using the methodology described above. Results are provided in Table 2.

TABLE 2

| SEQ ID NO.* | Trigger Length (bp) | Target Gene | SEQ ID NO. OF TARGET GENE | CPB Diet Bioassay Results** | dsRNA concentration (ppm) |
|---|---|---|---|---|---|
| 1095 | 277 | Exo70 | 1093 | (+) | 0.1 |
| 1095 | 277 | Exo70 | 1093 | (+) | 0.033 |

*sequence of anti-sense strand of the dsRNA trigger
**(+) significant stunting or mortality compared with water-treated control; (−) no significant stunting or mortality compared with water-treated control; NT = either (1) trigger was not tested, or (2) both of the following occurred: the sample did not provide significant stunting/mortality and the positive control did not provide significant stunting/mortality in that test. Positive control used in this assay was the dsRNA trigger targetting beta coatomer and having the sense strand sequence of SEQ ID NO:1086, previously disclosed as SEQ ID NO:880 in U.S. Pat. No. 7,943,819.

Example 6

This example illustrates non-limiting embodiments of polynucleotides of this invention, insecticidal compositions for controlling a *Leptinotarsa* species, and a representative assay useful for evaluating the *Leptinotarsa*-controlling efficacy of such polynucleotides.

Five dsRNA triggers (having anti-sense strand sequences of SEQ ID NOs:989, 1049, 1050, 1078, and 1084; see Table 1) for suppressing *Leptinotarsa* target genes were tested using the following leaf disc methodologies to assay mortality or stunting of *Leptinotarsa decemlineata* larvae due to contact with or ingestion of the polynucleotide triggers.

For the leaf disc bioassay with adult insects, newly emerged Colorado potato beetle (CPB, *Leptinotarsa decemlineata*) adults were collected and maintained on potato foliage for up to 7 days, and then fasted for 6-8 hours prior to beginning the bioassay. Fifteen adults per treatment (trigger/dose) were used. Ten microliters containing 250, 83.3, 27.8, or 9.3 nanograms of dsRNA trigger in a 0.1%

Silwet L77 solution in UltraPure water (Invitrogen) was applied to 15-millimeter-diameter potato (Atlantic variety) leaf discs; control leaf discs were treated with either the formulation 0.1% Silwet L77 solution or with a negative control trigger designed to silence green fluorescent protein (GFP). Treated leaf discs were placed individually into wells of 6-well cluster plates containing 2 milliliters/well of a solidified 2% agar agar/distilled water matrix. A single CPB adult was placed in each well and incubated overnight to allow it to consume the leaf disc; in cases where the leaf disc was not totally consumed, the insect was likely dead or damaged from handling and was excluded from the assay. The next day, the CPB adults from a given trigger/dose treatment were collectively transferred to a feeding arena made from a covered, aerated 16-ounce translucent plastic container lined at its base with filter paper and containing potato (Atlantic variety) foliage with stems inserted in a water-filled tube for freshness. The insects were incubated in the feeding arena in an environmental chamber (27 degrees Celsius; 60% relative humidity; 16 hours light/8 hours dark) with potato foliage replenished as needed. Insect viability was monitored daily. Insects were recorded as active (viable), moribund (does not return to feet after 10 seconds after being placed on its back), or dead. Viability results are provided in Table 3.

TABLE 3

| Treatment | CPB Target gene SEQ ID NO. | Days since treatment 5 | 6 | 7 | 8 | 9 | 10 | 12 | 14 | 16 |
|---|---|---|---|---|---|---|---|---|---|---|
| Formulation-1 | n/a | 100 | 100 | 100 | 100 | 100 | 100 | 100 | 100 | 100 |
| Formulation-2 | n/a | 93 | 93 | 93 | 93 | 93 | 93 | 86 | 86 | 86 |
| SEQ ID NO. 1115, GFP-1 | n/a | 100 | 100 | 100 | 100 | 100 | 100 | 80 | 80 | 60 |
| SEQ ID NO. 1115, GFP-2 | n/a | 93 | 93 | 87 | 87 | 80 | 80 | 80 | 80 | 80 |
| SEQ ID NO. 989*, 250 ng | 730 | 87 | 87 | 80 | 33 | 0 | 0 | 0 | 0 | 0 |
| SEQ ID NO. 989*, 83 ng | 730 | 100 | 100 | 79 | 43 | 29 | 7 | 0 | 0 | 0 |
| SEQ ID NO. 989*, 28 ng | 730 | 100 | 100 | 80 | 47 | 27 | 0 | 0 | 0 | 0 |
| SEQ ID NO. 989*, 9 ng | 730 | 93 | 93 | 73 | 60 | 33 | 0 | 0 | 0 | 0 |
| SEQ ID NO. 1049*, 250 ng | 807 | 40 | 13 | 0 | 0 | 0 | 0 | 0 | 0 | 0 |
| SEQ ID NO. 1049*, 83 ng | 807 | 80 | 7 | 7 | 7 | 0 | 0 | 0 | 0 | 0 |
| SEQ ID NO. 1049*, 28 ng | 807 | 80 | 13 | 13 | 13 | 13 | 7 | 13 | 7 | 7 |
| SEQ ID NO. 1049*, 9 ng | 807 | 87 | 73 | 60 | 60 | 60 | 60 | 53 | 53 | 53 |
| SEQ ID NO. 1050*, 250 ng | 808 | 60 | 13 | 0 | 0 | 0 | 0 | 0 | 0 | 0 |
| SEQ ID NO. 1050*, 83 ng | 808 | 60 | 20 | 0 | 0 | 0 | 0 | 0 | 0 | 0 |
| SEQ ID NO. 1050*, 28 ng | 808 | 86 | 29 | 29 | 14 | 14 | 14 | 14 | 14 | 14 |
| SEQ ID NO. 1050*, 9 ng | 808 | 80 | 60 | 60 | 53 | 53 | 53 | 47 | 40 | 40 |
| SEQ ID NO. 1078*, 250 ng | 812 | 67 | 27 | 20 | 0 | 0 | 0 | 0 | 0 | 0 |
| SEQ ID NO. 1078*, 83 ng | 812 | 60 | 13 | 7 | 7 | 7 | 7 | 7 | 7 | 7 |
| SEQ ID NO. 1078*, 28 ng | 812 | 73 | 33 | 20 | 13 | 13 | 13 | 13 | 13 | 13 |
| SEQ ID NO. 1078*, 9 ng | 812 | 100 | 80 | 80 | 67 | 60 | 60 | 53 | 47 | 47 |
| SEQ ID NO. 1084*, 250 ng | 819 | 33 | 0 | 0 | 0 | 0 | 0 | 0 | 0 | 0 |
| SEQ ID NO. 1084*, 83 ng | 819 | 73 | 33 | 7 | 0 | 0 | 0 | 0 | 0 | 0 |
| SEQ ID NO. 1084*, 28 ng | 819 | 73 | 40 | 33 | 33 | 33 | 33 | 20 | 20 | 20 |
| SEQ ID NO. 1084*, 9 ng | 819 | 80 | 60 | 53 | 53 | 53 | 53 | 47 | 47 | 40 |

*sequence of anti-sense strand of the dsRNA trigger, unless otherwise noted.

"Formulation-1" and "Formulation-2" are duplicates of a null control (0.1% Silwet in water). "GFP-1" and "GFP-2" are duplicates of a negative control using a 377 bp dsRNA trigger targetting green fluorescent protein (GFP) and having the sense strand sequence of SEQ ID NO: 1115.

"n/a" = not applicable.

For the leaf disc bioassay with larvae, neonate Colorado potato beetle (CPB, *Leptinotarsa decemlineata*) larvae hatched within 24 hours of the bioassay were used. Sixteen larvae per treatment (trigger/dose) were used. Two microliters containing 250, 83.3, 27.8, or 9.3 nanograms of dsRNA trigger in a 0.1% Silwet L77 solution in UltraPure water (Invitrogen) was applied to 7-millimeter-diameter potato (Atlantic variety) leaf discs; control leaf discs were treated with either the formulation 0.1% Silwet L77 solution or with a negative control trigger designed to silence green fluorescent protein (GFP). Treated leaf discs were placed individually into wells of 128-well cluster plates containing 0.5 milliliters/well of a solidified 2% agar agar/distilled water matrix. A single CPB neonate was placed in each well and incubated overnight to allow it to consume the leaf disc; in cases where the leaf disc was not totally consumed, the insect was likely dead or damaged from handling and was excluded from the assay. The next day, the CPB larvae from a given trigger/dose treatment were collectively transferred to a feeding arena made from a covered, aerated 16-ounce translucent plastic container lined at its base with filter paper and containing potato (Atlantic variety) foliage with stems inserted in a water-filled tube for freshness. The insects were incubated in the feeding arena in an environmental chamber (27 degrees Celsius; 60% relative humidity; 16 hours light/8 hours dark) with potato foliage replenished as needed. Larval viability was monitored daily. Larvae were recorded as alive or dead. Viability results are provided in Table 4.

TABLE 4

| Treatment | CPB Target gene SEQ ID NO. | Days since treatment 5 | 6 | 7 | 8 | 9 | 10 | 12 | 14 | 16 |
|---|---|---|---|---|---|---|---|---|---|---|
| Formulation-1 | n/a | 100 | 100 | 100 | 100 | 100 | 100 | 92 | 54 | 15 |
| Formulation-2 | n/a | 87 | 87 | 87 | 87 | 73 | 73 | 73 | 27 | 20 |

TABLE 4-continued

| Treatment | CPB Target gene SEQ ID NO. | Days since treatment | | | | | | | | |
|---|---|---|---|---|---|---|---|---|---|---|
| | | 5 | 6 | 7 | 8 | 9 | 10 | 12 | 14 | 16 |
| SEQ ID NO. 1115, GFP-1 | n/a | 69 | 69 | 69 | 69 | 69 | 69 | 69 | 50 | 38 |
| SEQ ID NO. 1115, GFP-2 | n/a | 100 | 100 | 94 | 94 | 75 | 75 | 56 | 19 | 19 |
| SEQ ID NO. 989*, 250 ng | 730 | 44 | 38 | 31 | 13 | 13 | 0 | 0 | 0 | 0 |
| SEQ ID NO. 989*, 83 ng | 730 | 19 | 19 | 13 | 0 | 0 | 0 | 0 | 0 | 0 |
| SEQ ID NO. 989* 28 ng | 730 | 69 | 50 | 38 | 13 | 13 | 6 | 6 | 6 | 6 |
| SEQ ID NO. 989*, 9 ng | 730 | 38 | 13 | 13 | 13 | 6 | 6 | 6 | 6 | 6 |
| SEQ ID NO. 1049*, 250 ng | 807 | 20 | 7 | 7 | 7 | 7 | 0 | 0 | 0 | 0 |
| SEQ ID NO. 1049*, 83 ng | 807 | 38 | 13 | 13 | 13 | 13 | 13 | 13 | 13 | 13 |
| SEQ ID NO. 1049*, 28 ng | 807 | 38 | 13 | 13 | 6 | 6 | 6 | 6 | 6 | 6 |
| SEQ ID NO. 1049*, 9 ng | 807 | 57 | 21 | 21 | 21 | 21 | 21 | 21 | 21 | 14 |
| SEQ ID NO. 1050*, 250 ng | 808 | 44 | 31 | 31 | 25 | 19 | 19 | 19 | 0 | 0 |
| SEQ ID NO. 1050*, 83 ng | 808 | 38 | 19 | 19 | 6 | 0 | 0 | 0 | 0 | 0 |
| SEQ ID NO. 1050*, 28 ng | 808 | 13 | 13 | 13 | 13 | 13 | 13 | 0 | 0 | 0 |
| SEQ ID NO. 1050*, 9 ng | 808 | 0 | 0 | 0 | 0 | 0 | 0 | 0 | 0 | 0 |
| SEQ ID NO. 1078*, 250 ng | 812 | 19 | 13 | 0 | 0 | 0 | 0 | 0 | 0 | 0 |
| SEQ ID NO. 1078*, 83 ng | 812 | 29 | 14 | 14 | 7 | 7 | 0 | 0 | 0 | 0 |
| SEQ ID NO. 1078*, 28 ng | 812 | 50 | 31 | 19 | 13 | 13 | 6 | 6 | 0 | 0 |
| SEQ ID NO. 1078*, 9 ng | 812 | 60 | 47 | 40 | 27 | 27 | 27 | 27 | 27 | 13 |
| SEQ ID NO. 1084*, 250 ng | 819 | 79 | 43 | 43 | 43 | 29 | 21 | 21 | 14 | 14 |
| SEQ ID NO. 1084*, 83 ng | 819 | 56 | 38 | 19 | 19 | 19 | 13 | 13 | 13 | 13 |
| SEQ ID NO. 1084*, 28 ng | 819 | 50 | 38 | 25 | 19 | 19 | 19 | 19 | 19 | 19 |
| SEQ ID NO. 1084*, 9 ng | 819 | 75 | 50 | 44 | 44 | 38 | 38 | 38 | 31 | 31 |

*sequence of anti-sense strand of the dsRNA trigger, unless otherwise noted.
"Formulation-1" and "Formulation-2" are duplicates of a null control (0.1% Silwet in water). "GFP-1" and "GFP-2" are duplicates of a negative control using a 377 bp dsRNA trigger targetting green fluorescent protein (GFP) and having the sense strand sequence of SEQ ID NO: 1115.
"n/a" = not applicable.

Example 7

This example illustrates non-limiting embodiments of polynucleotide triggers for suppressing *Leptinotarsa* target genes. More specifically, this example illustrates embodiments of blunt-ended dsRNA triggers consisting of a sense and a separate anti-sense strand, as well as embodiments of dsRNA triggers in the form of a hairpin (a single RNA transcript containing both a sense region and an anti-sense region).

Table 5 provides blunt-ended dsRNA triggers with sequences related to a "parent trigger" (see Table 1), where the parent trigger had been determined to have insecticidal activity against *Leptinotarsa decemlineata* (see Tables 1, 3, and 4) and the derivative triggers are blunt-ended dsRNAs corresponding to sub-regions of the parent trigger.

TABLE 5

| Trigger SEQ ID NO:* | Target gene name | Target gene SEQ ID NO: | Parent trigger SEQ ID NO: | Diet Activity vs. CPB (0.1 ppm) | Diet Activity vs. CPB (0.025 ppm) |
|---|---|---|---|---|---|
| 1096 | GTP-binding protein SAR1B | 819 | 1084 | (–) | (–) |
| 1097 | GTP-binding protein SARI1B | 819 | 1084 | (–) | (–) |
| 1098 | GTP-binding protein SAR1B | 819 | 1084 | (+) | (–) |
| 1099 | GTP-binding protein SAR1B | 819 | 1084 | (+) | (–) |
| 1100 | Probable 26S proteasome non-ATPase regulatory subunit 3 | 807 | 1049 | (–) | (–) |
| 1101 | 26S proteasome non-ATPase regulatory subunit 7 | 808 | 1050 | (–) | (–) |
| 1102 | 26S proteasome non-ATPase regulatory subunit 13 | 812 | 1078 | (–) | (–) |
| 1103 | Ribosomal protein L7 | 730 | 989 | (–) | (–) |
| 1104 | Ribosomal protein L7 | 730 | 989 | (+) | (–) |

*sequence of anti-sense strand of the dsRNA trigger

Table 6 provides dsRNA triggers in the form of a hairpin (a single RNA transcript containing both a sense region and an anti-sense region that hybridize to form dsRNA), with sequences derived from or related to a "parent trigger" (see Table 1), where the parent trigger had been determined to have insecticidal activity against *Leptinotarsa decemlineata* (see Tables 1, 3, and 4). Hairpin triggers are suitable for in vitro expression or in vivo expression when provided in an expression construct with appropriate promoters or other elements to permit their expression, e.g., in a bacterial cell or in a plant cell. The non-limiting embodiments disclosed in Table 6 each contain a T7 promoter (located at nucleotide positions 1-17 in each hairpin sequence) and a "loop" or spacer located between the sense and the anti-sense regions;

the loop contains non-specific (not complementary or identical to any part of the target gene) nucleotides. One of skill would immediately understand that the sense and anti-sense regions of the hairpin are useful in combination with different suitable promoters for expression in a given cell type, and with different spacer or loop sequences (or none at all, where nucleotides at the junction of the sense and anti-sense regions form the necessary "turn" or minimal loop in the hairpin). One of skill would also recognize that similar recombinant DNA constructs are easily designed to encode hairpin dsRNA triggers corresponding to the blunt-ended dsRNA triggers provided in Tables 1-5 or targeting the target genes provided in the Target Gene Sequences Group.

730). SEQ ID NO:1105 encodes a hairpin dsRNA having an anti-sense strand corresponding to SEQ ID NO:989 (see Example 7). The experiment was designed with 11 treatments arranged in a random complete block design with four replicates. Test plots consisted of potato plants (variety "Superior") planted in the spring in two 20-foot rows with 6-foot row center spacing; plots were maintained according to standard commercial growing practices. Foliar spray treatments were performed twice: a first treatment 36 days after planting and a second treatment 43 days after planting. All foliar treatments were applied with a 4-nozzle boom equipped with 110003VS spray tips spaced 20 inches apart, spraying 2 rows at a time, and powered by a carbon

TABLE 6

| Hairpin Trigger SEQ ID NO:* | nucleotide position of trigger anti-sense region in hairpin | trigger anti-sense region in hairpin, SEQ ID NO: | nucleotide position of loop or spacer in hairpin | nucleotide position of trigger sense region in hairpin | Blunt-ended dsRNA Trigger SEQ ID NO: | CPB Target Gene SEQ ID NO: |
|---|---|---|---|---|---|---|
| 1105 | 21-417 | 1110 | 418-566 | 567-963 | 989** | 730 |
| 1106 | 21-300 | 1111 | 301-450 | 451-730 | 1086 | |
| 1107 | 21-453 | 1112 | 454-603 | 604-1036 | 1084** | 819 |
| 1108 | 21-458 | 1113 | 459-608 | 609-1046 | 1050** | 808 |
| 1109 | 21-448 | 1114 | 449-598 | 599-1026 | 1038** | 828 |

*sequence of DNA construct encoding the hairpin dsRNA trigger
**sequence of anti-sense strand of the dsRNA trigger
SEQ ID NO: 1086 corresponds to the sense strand sequence of a blunt-ended dsRNA targetting beta coatomer, previously disclosed as SEQ ID NO: 880 in U.S. Pat. No. 7,943,819.

It is anticipated that the combination of certain recombinant RNAs as described herein (e.g., the dsRNA triggers described in Tables 1-6 or their hairpin equivalents, or active fragments of these triggers) with one or more non-polynucleotide pesticidal agents will result in a synergetic improvement in prevention or control of Leptinotarsa species infestations, when compared to the effect obtained with the recombinant RNA alone or the non-polynucleotide pesticidal agent alone. Routine insect bioassays such as the bioassay employing an artificial diet described here are useful for defining dose-responses for larval mortality or growth inhibition using combinations of the polynucleotide triggers and one or more non-polynucleotide pesticidal agents (e.g., a patatin, a plant lectin, a phytoecdysteroid, a Bacillus thuringiensis insecticidal protein, a Xenorhabdus insecticidal protein, a Photorhabdus insecticidal protein, a Bacillus laterosporous insecticidal protein, and a Bacillus sphaericus insecticidal protein). One of skill in the art can test combinations of polynucleotides and non-polynucleotide pesticidal agents in routine bioassays to identify combinations of bioactives that are synergistic and desirable for use in protecting plants from Leptinotarsa species infestations.

Example 8: Field Efficacy of RNAi-Mediated Control of Leptinotarsa decemlineata

A field trial was performed to test efficacy of topically applied dsRNA triggers on controlling Leptinotarsa decemlineata (Colorado potato beetle, CPB) infestations of potato plants under field conditions. Three dsRNA triggers were tested using topical (foliar spray) application: a blunt-ended dsRNA having an anti-sense strand sequence of SEQ ID NO:989, which targets Ribosomal Protein L7 (encoded by SEQ ID NO: 730); a blunt-ended dsRNA having an anti-sense strand sequence of SEQ ID NO:1049, which targets Probable 26S proteosome non-ATPase regulatory subunit 3 (encoded by SEQ ID NO: 807); and a hairpin dsRNA encoded by the DNA construct of SEQ ID NO:1105, which targets Ribosomal Protein L7 (encoded by SEQ ID NO:

dioxide-powered backpack sprayer at 40 pounds per square inch, delivering 38 gallons per acre. All life stages of Colorado potato beetle were recorded for ten randomly selected stems per plot at 3 time points: 3 days after the first foliar spray treatment (39 days after planting), 7 days after the first foliar spray treatment (43 days after planting), and 3 days after the second foliar spray treatment (46 days after planting). Defoliation, which is caused primarily by small larvae, was measured at 9 days after the first foliar spray treatment (45 days after planting). Two commercial synthetic (small molecule) insecticides were used as positive controls: Coragen® (chlorantraniliprole, DuPont) and Radiant® (spinetoram, Dow AgroSciences). Results are presented in Table 7; statistically different values are indicated by different letters (a, b, c, d, e). Those treatments that share a letter, for example the Untreated Control and 5 grams per acre SEQ ID NO:989 Treatment at 3 days after first spray which share the letter "a", are not statistically different; while those treatments that do not share a letter, for example the Untreated Control and Coragen® Treatment at 3 days after first spray, are statistically different. The effects of the dsRNA triggers increased over time and showed a dose-dependent response; at 3 days after the second foliar spray, all of the dsRNA trigger treatments except for the lowest dose of the dsRNA trigger having an anti-sense strand sequence of SEQ ID NO:1049 resulted in a decrease in large larvae that was not significantly different from the synthetic insecticide positive controls (Coragen® and Radiant Treatments) and that was significantly different from the Untreated Control. Defoliation also showed a dose-dependent response to the dsRNA treatments; several of the dsRNA treatments were significantly different from the Untreated Control and all of the dsRNA triggers at the highest dose tested provided defoliation protection that was not significantly different from that provided by the synthetic insecticide positive controls (Coragen® and Radiant Treatments). The decreased number of larvae and decreased defoliation or plant damage indicated improved resistance of the dsRNA-treated potato plants to Leptinotarsa decemlineata; these plants with improved resistance to Leptinotarsa decemlineata are expected to exhibit improved yield (increased harvestable tubers).

TABLE 7

| | | Mean number of Colorado potato beetles/10 stems | | | | | | |
| | | Small larvae | | | Large larvae | | | |
| Treatment | Rate (grams per acre) | 3 days after first spray | 7 days after first spray | 3 days after second spray | 3 days after first spray | 7 days after first spray | 3 days after second spray | % Defoliation |
|---|---|---|---|---|---|---|---|---|
| Untreated Control | n.a. | 115.8 a | 201.3 a | 72.0 ab | 0 | 45.3 ab | 108.0 a | 72.5 a |
| SEQ ID NO: 989* | 5 | 63.5 ab | 146.5 ab | 98.0 ab | 3 | 8.5 bcd | 8.3 b | 9.8 de |
| SEQ ID NO: 989* | 1 | 93.3 ab | 159.5 a | 144.5 a | 1.3 | 33.0 abcd | 21.8 b | 28.8 cd |
| SEQ ID NO: 989* | 0.2 | 87.8 ab | 116.0 abc | 118.0 a | 0 | 25.3 abcd | 33.8 b | 45.0 abc |
| SEQ ID NO: 1049* | 5 | 66.5 ab | 135.5 abc | 126.0 a | 0 | 2.0 cd | 12.8 b | 15.0 cde |
| SEQ ID NO: 1049* | 1 | 91.0 ab | 175.0 a | 102.5 ab | 0 | 41.3 abc | 33.8 b | 32.5 bcd |
| Untreated Control | n.a. | 115.8 a | 201.3 a | 72.0 ab | 0 | 45.3 ab | 108.0 a | 72.5 a |
| SEQ ID NO: 1049* | 0.2 | 93.5 ab | 113.8 abc | 99.3 ab | 0.8 | 59.0 a | 80.0 a | 68.8 ab |
| SEQ ID NO: 1105* | 5 | 61.0 ab | 91.3 abc | 117.8 a | 0 | 9.0 bcd | 14.0 b | 12.5 cde |
| SEQ ID NO: 1105* | 1 | 72.3 ab | 104.8 abc | 87.3 ab | 0 | 17.8 bcd | 8.8 b | 18.8 cd |
| Coragen ® | 5** | 9.8 b | 6.0 c | 0.3 b | 0 | 0.0 d | 0.0 b | 0.0 e |
| Radiant | 8** | 1.3 b | 16.8 bc | 0.0 b | 0 | 0.5 d | 0.0 b | 0.0 e |
| P-Value from Anova | | 0.0053 | 0.0004 | 0.0009 | ns | 0.0001 | <0.0001 | <0.0001 | n.a., not applicable
ns, not significant
*dsRNA triggers applied in a formulation containing 3 milliliters of a commercial spray adjuvant, TACTIC ™ (Loveland Products, Loveland, CO 80538) per 1600 milliliters water
**fluid ounces per acre All of the materials and methods disclosed and claimed herein can be made and used without undue experimentation as instructed by the above disclosure. Although the materials and methods of this invention have been described in terms of embodiments and illustrative examples, it will be apparent to those of skill in the art that variations can be applied to the materials and methods described herein without departing from the concept, spirit and scope of this invention. All such similar substitutes and modifications apparent to those skilled in the art are deemed to be within the spirit, scope and concept of this invention as defined by the appended claims.

SEQUENCE LISTING (1115 sequences)

SEQ ID NO: 1 - DNA, 1262 bp, Leptinotarsa decemlineata
  Annotation=NEDD4 family-interacting protein 1; Tribolium Gene Name from OrthoDB database=TC008147; Blast E-value Tribolium Gene vs. Leptinotarsa Unigene=5E-106
atgtaatgtattgataatattgatattcattatatacacctttcatccaatagaaaatataatttgcgattaaagatggatgcaaggttgactttccattgaatgtgcaatacaaagtgtgagaatctaaaatggcaattactccgcccaatatttgcaatcgtgaagaaacgaccttgcaagacatagctgttgacaataatctgcccagtccccaatctcttgctactacttcatcctccgaagacattccgcccccaaaggttgattattatgccccgccgccatatgaggtggctactaaagagacaaagttgccaacatatgaagaagtgcaaagagaaaagaatttagagggacaggatattcctattccaataaattctccaagtacgagagcattaccctttcgtcaaccagggcaaagaattataacaattgatgccgatataaatgaagaggtggatacatctctactaggaaccgacttcatgttttatatagccttttttgttgctttcattttcaattggataggattccttttattgatgtgtttttgtcacacaattgcatcaagatacggggccttgtcaggatttggcctttctttggccaaatggactttcattgtacagcactcaactgaattagcttcaaaagataacagttggttatggtggctgataatgacttttggtcttataatttgtattcgggctatactccaatatttgagtataaaaaggggatggcacatgctctctgcaagtcatcaggagaggctcttatttttttactaagcttcaaaacttgtgagtatgtcaaaagaaccttgttttatatactcgtctaaaattttgaatgtgattagaatccattgccttgagactacttcagtatgcattcctggtttcttcgaaatatttgtatagtaatgtttgtagttctaagataatatgtacattttatttttaaggaagcatatttttgtccagtttgtaggcacttgcataaagattgacagactattagaccatcaaaacacttagcgttaccacttgacaagaaaaggaagaactatgataagcacttgaaagttgttgatgttgccacacttttggtgttgtatacattaaaggtatccactgtgatgttttgtttatatttgtgtgacagttcttatactgcttaaaatgtacagaatgcagggtgagttgcagctggctaaattttttagtagagaatatcctctggaaggt

SEQ ID NO: 2 - DNA, 2434 bp, Leptinotarsa decemlineata
  Annotation=Zinc finger protein 180 (Fragment) Tribolium gene name from OrthoDB database=TC006630; Blast E-value Tribolium Gene vs. Leptinotarsa Unigene=3E-159
aaaaggttactgtttgggcagggattgtaggaaaccatatcactggacccttcttcattgagggcattttgaatggcgataattatttggcactagttcaaaatcatgccattccaagtttagcaaatttatatcctgatccaggaatccctcaagtaccagtaaataggatatggttccagtaggaaggagcaccaccacattaccaagttaatgtccggcaaaacatttcccaatcagtgaagagggaggcgaggaccgatttgaatggccagcacgatcacctgatctttcatcattagattccttttatggggatatgtaaagagcaatgtttacaaaactaaaccttcagatttgaatgacttaaaagaacgaataaagcttgtgattaggtcggtcacgcctgatatgttagaagacagttttatttgagattaggatgttgccaagacgtttgcgttgaactttttgagcatcttctttttaaaatccattgttctttttcgtattctacatttcattatgttttgcattatcttaattgttgcaataaacctgaaagcgataacatcctgaacagaaaatgaagagacctctcaaacaatatatcacaagtctacacttcccatctaaagaatttggggttgtatctgtcattcgacagatacaaccccaaacaaagggggttgaaggtagacatttttcgggattttaaataatgaatttattccaattggcttttacacactgtacggtcttcactcactgtgttccatttcattttgaatttgggaagtactctcttgagtttcagcatgatcgggatcatttacatcatcattaattacaacattctcatccgtatggtggtttcttacatgatctctgagagcgaatgctctggcataggttgcaccacacaaccaacaatcaaatttcaaattattttccctcttgtgggtttccatatgagttcttacagcatataatgaagcgaaaggacgattgcattctgtacaaggaaacggtttgatgtggctgtttttatgcccggctaactgcacactagttttgaaggccttggggcagtacgtacatttataagctctcacatctgaatgagtgagcatatgatggttgtaaacgctgtgtgatttgaatctcttatcacaatgaggacacttgtatggccttgtaccagaatgtgttcttaaatgcagggttagacaataactcactcggaaagatttcccacaaatttgacagacgtgaggtttttctcctgtatgtattcgttcatgtttgaccttctcgtgaggccttgcaaatcgtctaccacaatatcgacatacatattgtctgggctgacaaagcgttgctacatgatcttgtaaagcttcctcggtattgaaagcctttttacagtacgagcaagtgaacacttttttagtgttataatgaactttggtatgcatttccaaattttcctgtgaatgaaacttacgattgcagatagtacagtcaaactgatttccctcttcatgagacttcatatgaacttcttcatattctttgtcataagtattgttacatatattgcaaacaaatatttgacgaactactggtttagaatcacactcaacacctgacgagtaactgactggcgcttcaagaactttctctttcaccgggtcatgcattttttgatgcaatcgaagactcttgaaagaaggaaacattgttttacaaatattgcaggtatgcgggcttagagtaacaacgttggttaccatttcttctttttctttgtacgaatgagactccatgtgtgcatgtaaagactgatcgttggagaacacagcattacaatgaatgcatttcaatttgtgactgattttactggggtcgcataaatgtttcatgaagtgatctacttcaggaaatttcaaacaacactttggacattgataaatttgaaccagcgaattcttgtttttgatttgttcagcttcttctcctgatacttttctcgcctgtccattttcaaacgtatagttttcagtcatgggaccttcctcactaatatcttcgttattccaagattcatcagctctaaccattctaccgcctttgactgggcactgttgttcatcgatatcatttgaactaatgtattcgttatcaatagatccgtcatatatttcagtctcatcttgactcattgattcatattccacttggcagttttcaatactttcagtctcttcagtttccaatataacttcttccccactatggaacttgtctacatgctcttccattgaagtgaattgtatattgcacatgacacacatatacatcaagtttccatcttcaatatcattagactcgctctcttcattctccaaacatttggtgctgttttgaccaa

SEQ ID NO: 3 - DNA, 1551 bp, Leptinotarsa decemlineata
  Annotation=tRNA dimethylallyltransferase; Tribolium gene name from OrthoDB database=TC000060; Blast E-value Tribolium Gene vs. Leptinotarsa Unigene=7E-148
cccttttcttgaaccctataacagaatgtgagctgctctcaataataaataatatgattgtaaataagaatcgcctgaatttgttgagatctttatacgacaatagatttttagaagccttcgaaagtctagaaaacgaaaagtgtggaatgagatctacgaacagcatttcaaatagccatttgtttaccttacaattacaatagcaattaggcaagtatcttacatttcattcattaatgtcctgtttctcttttttcttcttactttctatcatcttcctgtgccgcgttgatttctgatggtgtgcccactgaaaatcgccgatgaaaattctgtcgcacacctcgcaagtgtgagtggtgtcatcactgttaggaaatgaattaccggacctcgatggtagtctttcgtgaacacaatggccaccggaaatgtggctttcaacgatttcgaatgcgattttagagacgttttcctcccacctagagacgtctgaagtatctagaccgtaaatcgggggaacctgcctgtcggtcctgctaaggaacctgttggcgatccaccggttttgtttccttgcgaatcgcctcgtcaccagtttcagctgatctatgccctccctcagtctcttctcgccttcatccgttgagcgtatttcctcgttcaacatcagatatgggtggaattccttgaatccaatggactgaaagatccctttagtgtaatcaagctccttgtcgtcactatttatccgttcttgattgtacaatttgtgaaagttcaacaattcttccagaagtccctgttccaacatgctatccacacgatcatccaacctcttgtgcaaaatatcctgattgcactgtaaccacaatactagagaagtgccgaatcgcaaaccaccacctgatcgggatgcatctttagctgattgttgctcctttaaaatttcgctgtgtctttttccatttttataaagaatttcaagagatcttaaaatctttcttttattgtttggatgtagccgccttgccatggacgggtccagtgctttgagcttctcatgcagctcctcactaggtaactcgtgttcattgttgggcagtactccaggcacctcggcgtaagacccgtcatcgattaatatcttccagagcagagactcaatataataattcgtacctcccacaacgacgggtagcttctggttgtcgattaactcctcaattattttcagagccctgtttttatactgggttacagtaaataattcatggggctcgagaatatcaatcatgtgatgaggggcagcggattgctcctcgcgcgtggctttggcggtgatgatatccagacctttgtacacctgcatagaatctgctccgattatctcaccgccgaatttcttcgccaactccaaagaaagtttagtttttccggtaccagtggctcccagaatcactaccaaaggcaatcgagaagacattgaaagcaccaatttatcaaaaaacagaacaaaaagtgaggttatgccccaccatcggcgtc

SEQ ID NO: 4 - DNA, 1383 bp, Leptinotarsa decemlineata
  Annotation=Par-1; Tribolium gene name from OrthoDB database= TC010125; Blast E-value Tribolium Gene vs. Leptinotarsa Unigene= 9E-52
tgttatctgctgcgggtttgggttgagcactggcaggtctagcattaagtctggcactattttccttaatagtagcactatcaaccgtattttgtcttttaaatcctgactggtgattattactttgtgaaacaggtacttgaggttggggccccgtccttagagtttctcctatggtgccacctccgctagacgctcttctattaggtttcgtgtgggtggcagaaattgaacgatgcactcctcgatgttgaggactctgtacagctggttgaggagtagcttgctgttggcctgtcatatttctaagcgataagctacttccgcttcgacttccatcactttccggatctgtgcttttccttcctaacagcaagtacgtagcgaatgcatcgtcatatttctgtgaatctaaggagttttcgacatcgtacctattgaaacctaaacaaactagagcttctatccttttgggatcagtcatgtcctgttcgggttccacatagggtttaagttcgtcgttctcgtacccctggttcatccatctatccttcatgatggtctctaaactcgccctcttggccggattcagaaccagaaacttcttcaggagattttcgcagtctgtgctcatataaaacggtatccggtacttgccacgaagcactcgttccctgagttctcgtaatgttgaaccatcgaatggtaaactgcccgagacgagtgtgtataatataacccctaatgaccagacatccacctcaggtccatcatattttttgccttgaaataactctggtgctgcatatggcggactaccacaaaatgtatctaatttgtttcccggggtaaattcgttggagaagccaaaatctgctattttaatgttcatttcactatccaacagtaagttttcagcctttaaatctctgtgaataatccttttttggtggcagtactgtaccgcagagacaatttgcctaaacttcgcccttgcttctttttctttcatcctaccgtgcaggacaagatagtcaaatacctcgccgcccgaggcatattccataaccaggtacaacgttttttccgtttcaattacttgaaataattttactatgttgggatggtctaacattttcattattcttacttctctaaatagtttctgtagcgaaccaggtgttagttgagtcttgtctattattttgatggcaacttccttaccagtgggtacgtgcttggccagcttgacctttgcaaagtttcctttgccgatggtcttaagtaatttgtatttaccaattgtcggttcctctcccagcctcggcctgttccgtgtagatgccgaaccgctccgcgtcgattccactgcgctgtcatttg

SEQ ID NO: 5 - DNA, 1163 bp, Leptinotarsa decemlineata
  Annotation=Ras-related protein Rab-30; Tribolium gene name from OrthoDB database=TC007212; Blast E-value Tribolium Gene vs. Leptinotarsa Unigene=2E-113
tataaaaaatattaagtacttggccctgctaaccgaattctaaaaaaatgtaaataaatataaaaatatgataaatctataatcacccaactagctgccataatagtaatagtgaagtaataaattaaactgactttacaattgacacagttgaaaaacaatacgaaaattgcagaaacaaaactatagtttgtaattctacaatcaacactgatgttatgaggaactgctgctgaggtaaagctcagttttaaaaaagtctttacacagttgactgagcaacttaaaaatatttgaaccaaaaagagctacaaaaaagttgttcactaaattttgatctgatatccaagcgggaagcactataaaaaagttttttctaatatacttaataattcgttataatagacagctacaacaaagttaaaattcaacaaataacatcctcttcctcttgactagtagtaacaataagtagctattaagagatacctaaaaaagtaaactagcacctttatgaaatgaaaaaaaaattagtactagaaagatgcaattcagatctagttgagtttgctacaacaactagagtcgctgattgttgaagttctgccattaagattttggctgttagaattataccttggaagatctttacttctggcttgcttcatcaaatcttccgctatttgcatgaacagtttttctacattgtctgattcttttgccgaagtttccagatagtacatattgtgtctttctgcaaattcttcgccaacatgagctggtatttctctatcttctctatctattttgttaccaacaagcacacgtaataccttactgctagcatactcttcgatttctcgcaaccaatctggtaagcagtcaaatgtgggctggcaagaaatatcgtacactaatataagggcatgagcagacctgtaatagctttgggtaattgacctgaaccgttcctgaccagcagtatcccatatctgtaattttactttttcattcccaacttcaacagttttaatcatgaaatccactcctatggtagcaccctggccaggtggaaaaagtccttgtgtgaaacgccgcacaagacacgtttttccaacgcctgcgttcccgactaaaacgactttgaaaaggaatttgtaatc

SEQ ID NO: 6 - DNA, 1467 bp, Leptinotarsa decemlineata
  Annotation=Growth hormone-regulated TBC protein 1-A; Tribolium gene name from OrthoDB database=TC010409; Blast E-value Tribolium Gene vs. Leptinotarsa Unigene=5E-159
catctactcaagctcatctctgctctaattaacatttaacaccaattaaaaaagtaatgaatcatccttagtatttttcaaattgacttggacatgttgggaaagagataacacttgcatcaatggcaaaatccagttacagtaaagtagacgaatatggatttgaacgcccagaaaatttcaactatgagtcatatgatcagtatatgtcccaatatttcagaatattgacccgtaggtcacaaagatggaacacattaaagggagatatcttcaaaaaacccaacaccctcaaaaggtttataagaaaaggaataccaagtgatcgtcgcacatcggtttggatgcacatttctggagcagacaatttgaaacgatcaagtaaattgacatataatgaactgaaaatgaaaattaataatcagaatataatagacacaatccaaatagatttaccaaggacctttccagataacatttacttctctactcatgagtatctccccaaaatgctctactatgtcttggctactttcgcacaccaaaacaaagaagtaggttactgccagggcttgaactatatagcaggattgctgcttctcgccacaaaagacgaggaagcctcattctggctcctcaaagttcttgttgaacaaattctacctcaatattacattgtaactatgactggcctcttgactgatctcgatgtcttagacgaactagttcgtaaatatgaacctgttgtacatagacatatacacaatattgggatgccttgggcaatgggcaccaccaaatggttcatttgcttgttttcggaggtgttgcctacagaaactgtattcaggatttgggactgcttgttccttgaaggatcaaaaataatttttagagtggcactaaccttgataaggttgcacaaggaaaatattttactaacaagtgaattgggagaactaataacttgttttaaggatatgaggaatcatcaatctgtgatcaattgtcatcaatttatgactgacatattcaagctgtcgggtaatttatccagttctacactcagcaaattgagaatcaaatataaaaaataagagaaaacaacacaaaggttcgcttctcacatatttcgctttactatgttaaaaatctagtctatatacatttttctaatgttaaatgtttcatttttgtacaaagcttttcaaagtataaattatcgatacatcatctagagtgtttttctaagaaatctttcgcctcattgatttttgatgcaaggtatggagatccacctctgtctggatgattaacagccattactttcttgaaagcgtcttttattttcaatttattcgcagagggagtcacacctaaaatcagcgctgcctctctccgattcattttggcatcgaaaccacccttgtaatattttgaattggccactgaggcagaatcgaattt

SEQ ID NO: 7 - DNA, 4094 bp, Leptinotarsa decemlineata
  Annotation=Wishful thinking; Tribolium gene name from OrthoDB database=TC009314; Blast E-value Tribolium Gene vs. Leptinotarsa Unigene=0
ttatgaaaatggaacttctctgataaacaaagctgcaaagatgttgtcactttggagcattctagtttttcccattctttgtgctggagtgttctcagaggattctgaagaacctgtattttgtgtgcattcagtgggatcctctgcacacattattataactgacgatgtggattctgatgctgggccttatcagatatgtaaggataggaacaagtactgttatactgtgtggctcgaggaccccaataatggaacaactgaaattatgggacaaggatgttgggaaatatccagccaaccgaacgactgcgacagagcggcctgcatagcagacaagaagcccccaaaggcgatgaacagcaccaagttctgctgctgcaaccagagcaagtgcaacgccaactttacggacgcgtatgtaccagtggatgacccgcccccgtccgatgagcctccccccatcacgccgctcaaccccatcgtttacatggtgaccgtggtggtctttctcatctttgtggccgtcatggcgatggtctcttactacttctggaggctgaggccaaggaaaagcgacgtcgagtgttgtcaacagcctctgccgcctccagccgattacagtttggagaagctgaagatgctgaatatcataggtcacggaaggtacggtagtgtgtggcacggactgatcgaagatcaagacatcgccgtgaaagtgttcccggcccatcataggaacaacttcctcaacgaacacgaaatgtacaaaatagctggagaaaatgccggcctattgaagttccatggaggaggggagtactccataatgcccggatccgttgattacgtcttgttattggccctcgaacaagaaagtcttcaggagtatcttaaaatgcacaccgttgatctggcgtcactgagcaaaatgagcctaggcattgccagaggcttggcccatttgcactcggacataggaaaaccttccattgtgcacagggacatcaataccagaaacattttggttagggccgatctctcgtgttgcatctgcgatctaggtttggcagtggcaccaagaatttccgagaacaaagccatcagcgaagctggtacccctacgatatatggcacccgaagtcctagaaggtgcagtgaatcttcgtgattgtgaaagcgctctcaagcagatagatgtctacgctctgggtcttgtcttatgggaactcggtagcagatgttccgacatgcaaaatgccgaaccaagccagtatgctccaccgttttccaaggtaggccggtgaaaatccatccctagagcaaatgcaatccctcgtgagcagaaagaaagtgagacctctgtggcctgtgtcctggaaagacactacggccgctaggatgctgtgcgaaaccgctgaagactgttgggatcaggatgctgaagctcgtctgactgccctctgtgtcgcggaacgcctgacagaactccctacactaaaagggcgtgtcttgcaccctcaccacccgcctgcaagtcccacccctctgatcaacaacaaccatctgcacgatcaccaattcgacgcctccgtcaacaccatagagacgcttctatccccgtcagaggagaactgcaaaaactcgaatcagctggcggtgtgcgttaccccgttacagccttaccaaggtagaaatccttgcctagaacgcaacctcatgtccggctctagcgacagccttctcatcgacaaatcctcgaagcactgcagcggcttggaatctcagaacctcattccgaacgagttcctcaacttccagatcaaccaccgagctgcgccgatcccgtacgtccagaacgctgtgcacgggggcaccccgaagcagcaaaacacctgctacagaacggtgaacaaaacgaaattcaagtggaacggacttaaaaacttcctaagcggcaagaggcactcgagctcaacgggcggttgcaaagacacacaggtcaagttgaatacgaaggtgcagaatggcgttacgacttcgttgttgcgcgaacaccagggggaaacgacgcggccttcttcgctgcctctaaaggcagccgaggcgcaggtgcagaacaattgcggtgtttcgcaaatcgcaaggcgtgataacagtttgtcgcggcagaggtcactggagcagtttaacgaggtgttctcatcgaccagcgacctttcgagactgaaggacccctctcagagggtaaaaacgcctggcgacgtaccgccctctgtgaggcggacaagaggcaaggcagcggccgattcggccacgagattctcactttacgatgacaggatgatgtgccgtggtcaatggggcagtgcccccgatctggaaccttctacggcgccccttcagccattgcgactcaacgaatcgcaggacagggagagcgtgagtagtttttaggcgttagttagtaaggaatggcgatgatgtaaatggcacgaaggaaatcgacgagtagggatagaattttcaattttatttaaattttgatattttgttttatgataacaccacacaaactgcattttcttaggcataaattgcgaagctggggttttactcaatggaaaaacccattcttcttctacatttttagctttgggactcgatatgagtcatgagcccagattcaacacagttcttgtattggggaggatctccagaaatctcaaagtgccaagactggccctagagcttttggcgccattcgagaattttctgaatgtttcatgtttttataacagaaatccaagaaaattacataaacgtaatgaagtaccccgtgaccagcactgtataattatgtatcagaaaatgtgtccatgcacagtgaacactttaaaagagatgattttactctgactttataatataatctatgtatcgcaaattatctgaggctgagaaatgaagttattttatttttcaaaattcattataatgttggtaccctctagattgaggaaactgaaccatgttctatcaactatgtaatggactattcttcataaggaaattttaggctgtggtcaaatatggtacctgttgatgatgcatccatagcagtgctggagagagcacggagttcaaaccatagtttgattttgtgcaggttctgttctgccctaaatcatgggtatcttcttagcaaacagctactcaatcgggacactctaaggaatcaaatagaactgacaaaactgaagcgagggggtgggaggaaccacaccacacagtagtaaacaaccgccacgtatccacaaaatccagcaagtctaaggctgggaaatcatctggttcacaggagacgaagactagtaatttttcgttaagaaacctgagtaggaagtgcactttgcaaggatccaagaaacaagctggaaagtgttttcgcgttgccatctgaaccaaatcatcttttaacgttggtgatggcagatgaaggtgtcaaataacccttcatctctctcctaaggtcgtagagaaatacatttggctgtgacaatttgttcaaataacatccttgaagtatgagcgataaaaatatttctttggtttccttgaattttgcagcgccgtcttgcggcaatgatctcgattaaatctgctctcttattttctttgttttgggttcaggtgacaggtagttcacccagttccataaagcgaatttcaagggaaatagaaaactaatttttcttttgaatcttgggtcattcttaaacgaacataaattgttttatagaatacaagtagaacgtcagcttccttttgttgtgtgttcaatctctaagtgacctcataaaaaaaatccttcttgtctgttgagatttccattgtgagacaaatatttatgaatagatttagtagatagtgaatgtacagttatttacaatgtttttcaattgtattggcaagtgcaatttattccacgagtaacttaacttgttacaaggtactaattctagtacaaatctggacagtttttcattttctttgttttttttttaacaaaatgaagtttgtgctccactttt

SEQ ID NO: 8 - DNA, 893 bp, Leptinotarsa decemlineata
  Annotation=Protein drumstickTribolium gene name from OrthoDB database=TC006347; Blast E-value Tribolium Gene vs. Leptinotarsa Unigene=8E-50
ggacagcatcaagaggttttctttctcaaggtataaatatacttgtttcgaacagaaatgatatttctacctcaaaagcgttcaaactgaattgctattcagtatttttttccaaaaataaccagaccagttgaagcgatgaatattggcaattgaagttttatttcgaaatctcttgagacaaattccaacaaaacgattttttcatgaaatgtgcattgaaccatcagtgatgaataacattttgaaaatcatgaaaatataaaaattctactgatattcattcgaaaaacatttttgagactagaaagttgtggtcgattctttgaaataaatttcaatgatagaacattcatatgttatttttacacctattctaaatatatacacgataaaaattagatactgaaaattgtaaatactgcattctgaaaaattgttattgaaagcctatgaaaattaatatctgccactcaagcaactacatgttgcactggatgggtagtgaattgtcattgtatgagaagaaaactggactgggttagcccttgttcatttcaccaggtccctttaccgccagatgcactgattacatctatgttgtttaaggttatcctgtttcttgaaactttttccgcaaacttcgcagctgaaagtaacttcggggctcttgtgggttctctcatgtatcatcaaattatagggtttcgtaaatcttctttgacaatacttgcaaatgaactcgcacttcgaacgcatttttcttctgaactgtcctccactaacgtcgttatctatctgcataatagcaaacatcttgatttctttatatctttattggcaccaatgggactattcgaattatcgtgttatctgatatcttcctaattttt

SEQ ID NO: 9 - DNA, 714 bp, Leptinotarsa decemlineata
  Annotation=Lectin 4 C type lectin; Tribolium gene name from OrthoDB database=TC013911; Blast E-value Tribolium Gene vs. Leptinotarsa Unigene=2E-53
atacaatattatacaatcgaaagtaatactacttacaaaaactaaaatactaataaaaaaggttcaataattggaaataaacatttcgtgtctatatacatatgcataatgtatagagtatgaaaaataagaatgaaagaaatatttcgttaatttttagctttaatcatccagaaaaacatgtttttaaatccctatggttcttcggatagatggcactacttataccgccgctttagaataagttaatcataccttagattatttgaaaaaagaacctcaaatttttttgtcgctattgaaacattctctaatttttttacgtagcgccattgtggaaaaatgaactggtcttttttataaaaacaattataaaagatactgagaacgtgatggcggagctcactcgcatatgtggcagtttaatttttctcgtcaaggtcttacaaacgtataccacggttggtggatgctacataattaagtaactcatcggaatcctcgcaaacaactggtttctcgtggtaacaagcgacgtcgtgccaggcgatgccgtcgttgtaaacgttgtttagaatggaaaggcaagactcggtcgttctgttgatgtcaaattccgcgttgtcaggctgtttctgttttttgtgacctgtttgggaccaaggattgtagctccatcccgccggggtacggttggtagcctgaatcttttcg

SEQ ID NO: 10 - DNA, 1555 bp, Leptinotarsa decemlineata
  Annotation=Serine/threonine-protein phosphatase 2A regulatory subunit B'' subunit gamma; Tribolium gene name from OrthoDB database=TC009266; Blast E-value Tribolium Gene vs. Leptinotarsa Unigene=0
gtccgaaacttaccgaaggcacagtgacgtcggtatttagaagggggtttattatttgaatgaataaatatgtgtgatttcggaagatattattatatatagttgaaaaaaaacactcctttcagtttactagcgaaaattagcagttatgtctgaaaatcctgtttgtgcgtgagcagaaaaaatggatttaaaagagatactgaaacaaaaacttgagaaaacagcttcacaaatcagttcaagtgaaaatgaacagatggaagaaaaatatttcaaacaatatcttgcagagtggaaagaaacaaaggcacctccagaacgaggcatcccgaagttcttcaataaactccctaaagagaatgaacccctgcggtcgaaactgagagaagaaagtcgttctaaccttctcaaaagaagaagttcagagttattagataataatgaactgaaagagctttggacacttcttgatcaaaatcaaagtttttcggaggaacagttaatcacatatagtgatttccaaaaagttgctaattcggtgggccccaaagtcaaaccatatttcacccctattgtatttgcaaagctccagcaaggtgacccacatggaagagtgtcgataatgtcactcttcaactatgttatgaggaaagtgtggcttgatcagactagaattggtttgtccctgtatgatgccactgggcaaggatatcttacagaagcagatttggaatcatacattactgaacttctacctactctaccacaacttgaagggcttgagaagtctttccatagtttttacgtgtgcacagcagtgcgaaaatttttgttttttcttgatgttgttagagctgggagagtgagaattctcgacattctagcctgttcatttcttgacgacctattagaacttcgagatgaagaagtgagcaaagagttacaagaacaaaactggtttagtgctccttcagcactccgcatttatggacattatttgaacttagatagagatcataacggcatgttaagcaaggctgaattagctggttatggttcaggcactttaaccaaaccatttttagatagagtatttcaaacatgtttaacctatggtggtgaaatggattataaaacttatttagatttagtacttgccttagagaacagaagcgaaccacaagctctggcctatcttttccgaatattggatataaaaaatggtggttatttagattcattcacactaaattattttttcagagcaattcaggatcagatgaaagctcatggcgcagaacccgtatcttttcaagacgttaaagatgagttgtttgatatggtgagacccaaagatccacagaagataaccttggctgatttactagcttgtggtcaaggcgacacatttgtcagtatcttgatagaatttcatggattttgggcttatgagaatcgtgaagctttgtcatcagaaccttcacaagattaatgtgatattgtttgagatgtatatttttgtactttttaaataaatttgtctgtatagtta

SEQ ID NO: 11 - DNA, 3710 bp, Leptinotarsa decemlineata
  Annotation=Regulator of nonsense transcripts 2; Tribolium gene name from OrthoDB database=TC002851; Blast E-value Tribolium Gene vs. Leptinotarsa Unigene=0
acaaaaaaaggctttcaatactgcttttaccacaatcaggctaagtgaatctcagaagtcttagtgagacgtatgctggaaaaagctttgcattttctacctaataagtccaaagtatgtttgaaaataaaataaaaaatttactccgaattttttgccttaatccattgaaacatatattatttcaccgaatcaaaatgttacaggatcccttgaaattcttgaaggaaactccatcttggggtcacattcttctattctgccaaaaatcgcattgttcaacaaagtgcgtaatgcttacatgtttgaaacccaattttcgttgtgtcacttcctaccgaactttctttggaccaaatatcaaatcggcatcgggggcccccttgggatgttgatattttttacgttctctatttaggttttgtgtaacaggtctattttgttgttgaatcatctcctgataatcttcttcttcaaacctttcagtaatatttaatgttagtcgttttactttctccttttcttctttctgaacctgttcttgatctcttaaattttgggccaattctgaatcaatctccgcctcaaattgcttgtactgctgcttattgcctttacgtaccatcaaaacgaaaccaattttcccttgttcgttctcactaggtggttcctgaagttgttcgtaagttttcttgacattagatttcataacaaccggaaccgaaatgtcaacgttgccagctttaataggttctttcattctttcctggatattttcagaaaccattttatctagtgcatttaaaaactcatcatcttctggacaatctaccctatttgggcctttaggaatggctaaagattctgatactggatcttgttctgcctcgcttgtatttggttcaccttcatcatctgatccttgggtattatcaactgtttcatcttcagttgcggtatcgtctgttattggtccagttactccctcagaagtttcgtcgtccacaccttcttcgttgtctgtctcggctatggtatccaacccatcttcatccaacactgtgctgtctacctccaatagtttctcaataccgagggtggtacgaatattattcacctcttctacagcttcttcgtaacttttacacagtttcagtttaggtctgagagctgtcaaagtttctttaaaaagatgttctaacatcggaggaaatgattcttgccaaagctttttcttgtaccagtagtaagcttgtaaaaacactaaatagtagtcaagtttttttttactgcttccgctactgaaataagtaccacaagtttccagtaagacacatgccagccgaattcgaaacagttggtttggtgggtccaaaggagatatttctgttggatccatggacaccccaaatgatataatggaatagagaatcttgaaaacgtcggagctttcaaccattcgatagttatacaattcacctaaatatttgacttgtgcaattcttcgctggttgaattttggtagattcacttccatacccaatctaatgtcttccaaaacgttatcaacaacttttgttccaatttcttcttgataagctacaagacctgccagtaaattcgccagacatctgatgttgaagtatttgagattgtgtgctcctgacaaacatttgattgcataggtagatatctctcgatttgaccaatctaatttcctcatcagtctcattattttgtctgtgttatttttctgtaggtcctgatacagcaattttctgatgaattgatgcatgacaggcctctccttcttcgcaatcgtgacaacttctggtgggttgacatagtaataggcattttcaatctgagtaacgtatctcgaatctaaaggcatcacagatttttttctcatcatctgttccaggtacacctttgtcctctggtgagaatcagggctacagtacagaaatcttccacaaacttccagtaaattacaggccatttctatgtggtgatgggaaaagtcatgcagtaaaacctttaggcagtaaagtgcctctatttttgaatacaaattgaatttcactagttctcctatgaacctaacgacttttatctttgattcgatgtttatttgatctttctttctaacatgatatttgaaatcttgcctcagcatttggcacagttcatttcctacttccggcagagctggttggagaatagctacgaagcgggcatagaatggaagcaaatctaatctggtacgattcacagcaaacaaactacggacaagttttttacggttatgtttggtgttgagcgttactagaaaatctattgctgcgttgtcaatcatctctctattgacacaattgggtaaattgttcaaaaatgcttctaaaactattttattactagctgttgttgttgctacatcctctgtttcttcctcaactgcaggaggttcttctgttttactttcttcttccaaatcttcaactggcaaatctgaatcaagaacttcttccgttacagtttctgctggcggtggagtttgccctttattcaaaaatgatgtaggaagaaaaacagtcagttcaggaagatcacaataaaatctctgtgtttcaatatcacaccaaatattttctatattaactgtaacgtcctccatatctgttcctgaaccagtcacaatcatactctcctcattttttggcatggtttgcacttttaatgtcggcatatcttcatctaaaatatcagaaaaattttgggtatttgttaaaagtttatcgtaagctgactgaagtgactcaagtttttccttcctctcctgacttaattcacctttggtttgcaaaatacgcatattctgtttctcaaaattttgcatttctatgtggtctttaaccaaatgtttactaagagagatataataatctttcaaaagacatctaacattttgtttcttttctggcggtaaaaaatcacttcggggaatttccatctgatatttgatagataactctcgcatacgtctggaaatgaggcctgcataatcatctccacagtgtttgcaaaaactcaatataatagaagcattgaaatggtcttctttatccatatttattagattcatcaaaacggatcccagtaaggttagagcattcttatttgagaaaattcctgcttgtagcaaatcagcgtaaaaccttaaatcgactcgtaatttacttggattgggaatcttttcccccagctttatcgccaatactttctgccaattctcgaacagatgctgtgaaaattctatataagtttggtgaaggatactacataatttaactgccgcaggaacatcattcattttgagttttgcttccactaatgcagcagccacttccgatatatatttcgacaaattcaatccaaacatatctttgaggtaactatcaagatgaacagaggaaaaattcctaattttctttacaaacgcagtgtttttctttaaacttgaatccaatttactaaaatgagagtcacttggtcgtgaatttagggcattttgatttgaaattctcaattcttttttgaaattcaacttttcttgtacctcttcaataaatgaggttaggctcattttttcagtttcatctgatttgtctccacattcttcttgattgggatcgttgatagtcattgtg

SEQ ID NO: 12 - DNA, 1804 bp, Leptinotarsa decemlineata
  Annotation=Rab GTPase-binding effector protein 1; Tribolium gene name from OrthoDB database=TC006665; Blast E-value Tribolium Gene vs. Leptinotarsa Unigene=6E-172
agccagttagttgttgatagtattactttagaatcaaattttgaggtagaaaaacgcaaagctgaagaagaaatagcaacattacaaagattaatacatgaaagtgaggcagaatcaagttctacaaggactctttatgatacagaactaacaaaattagaaacttacatacagcagttgcaaaaagaaattatagatttgaaacgagagaaaaaccaaacacatcacatatcacaggatcatagtagtttagcttcaagtcaggtattgaatgttctaacaaaaggattgaaaaagcttggtgcagattctttctcttctcaagaaagtgtggatgatagttccaaaaagactgaggaggatgcagtggtgttacgttcccttgttgaaccattggcggaccaaataaaggcgctcaaagaaaaactgagagcaacagattttcaactacagaaatgtaaagagtgcggtcatcgccaagatgagacaaatgaaactgttgatcagtcgtctcaacatgtcaacttaaatgcaacaacatcaactaatacgtcatttgagtcccagaaactttcaatatgcgatatgtgtagcaactatgaggccgagttggtcaaggaacagaaaaaaatagtgatttgaaagcagaggttacagctgcagaaaaggctgctgagagacacaaggaggaattgttgaaagaaatcggtttcaggaaggacatggaggagaaatggaatgaaaagaaagaggaacataaacaacaggttgcagaactaacgagggcaacagaatgtatggagatggatttaaaggagctgcgacagttttttaatcgaacatgttctgaaatgaagacgagtttagagaagttaacccacgatagagaaacaattcaacaagaactcaaaaagctgcagaaagaaaatgataacttagtgggaaaatatactgtacattcccaggaactacagagtgaagttatagatctccctaatactgttgaggaacttcatgaggtaatattaaaaaatcatcaagaactgataattgcaaagattggcaaagaagcggcagaagaagcagccagtacacttcagtgcgagataatgtttttaaaggacagaataactaatgatcagcatgaacgaaagggtatagaagatacactagagctggaaataagaggcttgaaaaaacaaatagatcaattgatgaaggaaagaaaacagatccattcaaatcaagaaaaactggttagttctgaatctttgaatcaagaaaagatcaaggaacaacaagatagaatcaatgaattcacagaaacaatcacatcactggagaagcaaaacaaagagttgaggaccagggtgatttctcttcaacaggaattagatacgacggagactgttcaaaaggattttgtcagattgtcacagagtttgcaggtacaattagaaaaaattcgagagtcggataatcaagtgcgatggcaacacgaagaggatgttgagaaatgtccaacttgccattcaagcttttcaacggcaaagcgaaaacaacactgtagacattgcggtcaaatattttgtcaaccttgtttgtcgcacactgttctatcagggcctaatagccgcccttctaaagtttgtgatgtttgtcataccctactagtcaaatcttctgccccttatttcagtgaagctcctccgatgacgtgaaattcttagtcacctagtagctgtatttgattgttaccgtctttaaattttaaaacgtgaataaattcattccgaaattttac

SEQ ID NO: 13 - DNA, 2350 bp, Leptinotarsa decemlineata
  Annotation=SWI/SNF-related matrix-associated actin-dependent regulator of chromatin subfamily A containing DEAD/H box 1; Tribolium gene name from OrthoDB database=TC006624; Blast E- value Tribolium Gene vs. Leptinotarsa Unigene=0
atactggttatgatgaatggaaacaggattatgatagaaaatttgaggagtctaaacaattacaactgactactaatggattatttgacagaacgcaaagttttaaaagacaggcaacagaagaacctacaaaaaagaaaaaagcaaaaagaagaaaatcatatgatagtgatgacagtactggtagtaataattacaaagataaacgagtatttgatagtgatgaagattctgatgtggaaatcagtaatgagctaactggtgataagaaaagagtattagaattttttgaaacagcaacagtcaatgaattgcagctgatgaactcttgttcgaaaaagaaagcagaagctattatagaatctcgtccatttgtaggatggatagatttggttgaaaaactgcaaaccaataaattgagtacagacttgttgaatgctgcacaacaagtgcttactactagaaataacattaaacatttgatgaagaagtgtaccaatttagcccaacagttggaaagagcagttgctgctggtgcaggagttaaagaacaacctcgcactttgtcatcatccttgaaactaacgggttaccaaatggttggcctgaattggttagtggttttatattctcaaggagtgaatggtattttggctgacgaaatgggtctcggaaaaactgtacaaataatatcttttcttgcccatttgaaagaaatcggagcagcctcaagcactcatcttgtcattgtgccttcttcaacccttgacaattggaaaaatgaatttgctcgttggtgtcctgaactgagaattttcatgtattacggaagtacagaggaaagacgacaattccgaattgatttggcaaaaggaatgctttctgaatttgatgttattttgacaacatatacaatggtaggcaacagcccagaagagagaaaaatgtttagagtcaccaggatgcattacgttatatttgatgaagcccacatgttgaagaatatgaacactcagcgatatgaaaatttgattaggataaatgctaaacatagaattctcttaactggaacaccgcttcaaaataatcttctggaactcatgtctttactgatctttgtgatgccgaagatctttgcagagaaaacagacgatttgaaaagccttttccagaaaaattctaaaaaagatcaagatgattccctaccgacatttgagagagaacaaattgagcaagcaaaaaggataatgaaaccgtttgtacttcgtagactaaaatgtgatgttctcaaagatttgccaaaaaaaacggactttatagtgacggttcctatggtaccttcacaaaaggagaattatgaacatcttgtggcatcttataaaaacattgatgagaatggaaaaatacctacagtggcatgagtattatgtcggatttgaggaaattgtgcaatcaccctttgttaatgaggtatcactatgatttgaaacaactgcaagacatggctaggttactagcagctgatcccggatataaagatactgtcgtgcagtatattgtggatgacctaacctggatgtcagattttgaacttcacacattgtcgaaagattttcggtgtttaaatcggttcaaacttcctgacacaatgatgttaacatcggggaaattctcacagcttgacaaaatgctgccagaattgaaagaaaacggtcatagagtcttaatttttagtcaatacgttattatgttgaacatagtagaagaatatttgaggataagaaatcacaagtttttgagattagacggcagtacagctgttcaaattaggcaggatctaataaatgaattcacagaagatacaagctactttgtttttcttctatcaaccagagccggtggtttggggataaatttgacttctgctgacactgtgataatccacgatattgactttaatccatataatgataaacaagccgaagatagatgtcatcgaatggggcagagtaaaccggttactgtataccgattcatctcacagggatccattgaagaaggaatgctggaaatgaacaaagagaagctcaagttggaacgagacattaccacagaagaatctgataatcctgacgtgaaaagtgtagtacgattgctgtcttctgccctaggaatcgattcgatgaaggctgcaagtcttgtaacaccaccaaagaaaaaaaccttgaatgttgtgaaattgatttttatatacttatatttaatcagttttgttaaattgtcaaatctgttgtattagaatatttattcttcttttatccgtattgacacttaggcactcagtgagacc

SEQ ID NO: 14 - DNA, 1878 bp, Leptinotarsa decemlineata
  Annotation=Probable ATP-dependent RNA helicase DDX27; Tribolium gene name from OrthoDB database=TC009390; Blast E-value Tribolium Gene vs. Leptinotarsa Unigene=0
gttggggcctaccgaagctctttccttttttttacagtttttttattgctcttattttttccttctttattcttcattttctgtttgaaattagcatcatatcgaagttttttcgcctttttctgtgatgtatcgaccaaatctgcaaaatgtgacttccgttttttacctgaagccgcaacagctgccaaagtgtcatcttttactgtggcaatcttcttttgtttctgttttctcttagccagttttgcttgaagtaaagcaactttgttcaattcattactgactctatcttctggtgtttcttttccgccttttttatttttcttcttaatgtctttagatattttattcttttcgtttacatttttgagactaagccgatctttttcttcctttcgctgggttttggtctgaaaccatggtcgcttctcgtcttgctctcctttcagtaatttttcagccttgttcgcttggttttctactttactaagcatcctctcttcatattcttcttgtaggatttgtgtaatctgaggttctaatcgcagtaatttgtccttgtacttctctaagatatctgcaggtataaccctacttttaacaggattttttgctcgtttaatacatcttttacaattttcctttccttctcccctgctaaacttacagaaaccccagcacgtcctgctcttgctgttcttccgactctgtgaatgtaatgctccacagtggcaggcataataaaattaataacagtctgaactcctgatatatccaaaccacgagcagcaacatctgtagctatgagaatatcaacttgttttgtcttaaatttttctaaactgtctaaacgctgcggttgggtgaggttaccatgtagttcagccactcgtagtcctagtaaacctagcaagatatgcaatcgatgggcttgctttttagtctgtacaaacaccatacagtgttcacgaaatgttcgacaaactaaagcagcaagaattggctctctttcagcctctttctctgacctgatcctgatgaactcttgtctcaaattgaatgctacatctctattactgtcaacaaacaatctaactggtttagtgagagaaacagctgctaaactttccacttcatcagtcatggttgcagagaacaacattgtttgtcttttctttgagcactgcttgatgatttcattcatttgttcagcaaagtattcgtcaagcatccgatcagcttcgtccagtataagtacttctactgattctaaactaaatgttggtgtactcttcaaatggtcaattaaacgaccaggggtggcaatgacaatatctgggttttttctcaggatgccttcttgtgttttgagatccaatcctcctactgccaaaccgatttggatgtctgaaaactggctaatttgtttggtgacttggtaaacttggacacctaattctctggtgggaaccagaactaatactcgagtgactggtacattgcctgatggcctatagaggagacgttccaaggttggtagcatgtaggcagctgtcttacccgtacctgtggcagcacacccacaaatatctctacctagcaaagctactggaattgttgccgactgaataggagttggatggacaaacttcatttcagaaatagccttcaataaaggtcgtgataaattcatctgatagaaactaccagcctcagtattgatttcaatatcatcaaaaaatgtttccgtttcttcactagccttgactttctttttcttattttccttgactttgatcttatcatgtttcatttcatcgtcggacaatgaaatatctgagtgttcatcttcctcatctttttcatcattatcat

SEQ ID NO: 15 - DNA, 1785 bp, Leptinotarsa decemlineata
  Annotation=ESF1-like protein; Tribolium gene name from OrthoDB database=TC007375; Blast E-value Tribolium Gene vs. Leptinotarsa Unigene=4E-150
caattactattctaatttagagggccgttataaatagaaataaaatgaattgaaaattcattcaaaacaacttctatcaaataatcttgcatcagtttgtttaataaatatatattacttatataaatatatcatttgttcatatagtcattagttttcctcttcactgatttaacgagcaagctcagttcagcgtcctttttaccacctcgatttcctttaactttctttacaacaggttcgccattgctctcagccctcctcttcaatttttctgatatcaatgtttccatacctttggtttttttgtaatgtggatcagttggatctatattgaagtggtgactattgaataatgctgaaaatctttcatcagcaacattgacctggaaatcgtcctccactttactttcaccagcatctttctttgatttattctttcgcttctttttacttttagattcattttctgcatcttgtatttttttaagactaaagtgctttttgccctcgtcttcattcatcagcaatagatcaagttcggcttgttgtttatcatccttagtttcattgttagtttccttcttttctttcttacgaggttttttgaattcttcattatcaaattcttctgcaaagtagggatcattcatgtcgatatcagaaggcatgtcagagtcattgtcatctttcatttctgtctttttcttggaacgtttttctttccgcttctcttttcttttatctagatacttctcgaaaggtgttttatcttctgaattattttgtttcttctttaccaactcctcagtcttctccttcagatcgattccccaagaaatttccatttcaacatctttattctttttagccttctccttatcttctatatccatcaacaaagccttatatttatcaataacattctccccctggttatcttcagaatctttatcactttcatccttctcttccttgcattcttcttcatcactgctactagccaaatagttctgcaaatctgcttctgatatttcttctagtttaccagaactgagtttttgtgaaatttccaatctatctggatttgtttcgtcccatgttaaatcaacttttgcttgttgaagagccgttgttgtgaaaaacctaggctggtacttgttcacttctggcagcttatcacaaacttctttaggttcattgtcaaactccatgtcatcagggatgaacctcaagtccagcttcacagcacttgactcatattccattccatcgcattcagtgtatattttgtttgcagtactggcactatcaaacgttatgacagcatagtaatatttgagccgattgagttggtactgccgcagtttttccatgtgatagttggaaccctcttcgttttcgtcttcattttcttctgctttttttttcgaccaattctatggggcctttcacttcttcttctttcatgcgggctttaccaaattcggaggggtagattattacagattttatgacagaaccaggagttaagaatgagttgaaaagaaccattaaatctactgcccttattctgtcccagtccatattacaggctgctaacctataggtgggtttttctgtctgctcagcatcattgtccaattctccccacttgtgatccaattcttctgtttccagtaattcctcgtcgctttcctcatcatccgaagaactttcagaaaataatgccgattcgcctctggcatagtcaatttttaagttacgaagtctttttttcgcttt

SEQ ID NO: 16 - DNA, 1180 bp, Leptinotarsa decemlineata
  Annotation=Probable GDP-fucose transporter; Tribolium gene name from OrthoDB database=TC012326; Blast E-value Tribolium Gene vs. Leptinotarsa Unigene=4E-123
tcaacttagatgcacccatgttcatcgcactcagtcagactttgatcactgctctcatttgtgttttgaaaaaaaaaattgagcagaaaatatcctggaaagttcagatttcctgatgtcgatgtttgggattggtacaccattaaagggattcttccattgtcaataatatttacctcaatgatcgctaccaataacttatgtttgaaatatgcctctgtgacatattactacattggcagatcattgacaaccattttcaatgtagttttcacttatctgatattaggagagaaaacttcgaaacgatgtgttgtttgttgtgcaataattatttttggattttggatgggagttgatcaagagaatttagcaggaagtttatcggtggctggtttcgtatttggaattttaggatccctctcgttatcgctttattcgatattcacgaaaaaggcactgcctaaagttaatggagaaatatgggccctatcgtacgttaacaatgtgtacgccacaataatcctgacaccattaatggcaatcaacggggaattgacggaactatataactacagcgatcttctcaaaacctatttttgggtaatcatcaccataggcggtgtatgcggtttcacaataggatttttcacaaccatgcagataaagtacacttctgctttaacacacaacatttccggaacagctaaagcctgtgcccaaacggttctagcgacatattggttccaagaaaccaaatctttggtttggtggtgctcaaattttatcgtattgtttggcagtgcttgttatacttggatcaaacaaatcgacatggaaaaaaggcatagaaacaatccaatataccataaagtttaagaataatgcatcggtttggttcaacattcctgtacatttttgtaagaagaatctgttggatcatgtccacacaatacatatgttgataggttaatcttgtgttggacaaatcaacgttgaaggatttttcaagaggataggataatctagtcaaacaattcattatatctggttcatgtcattaaataagagtgacttactactgcttgaaaatgttatttttgaaagaattttaaatataaatcgattttataaaaaaaaaaaaaaaaaaaaaagtaactactagacgttagaataacca

SEQ ID NO: 17 - DNA, 1419 bp, Leptinotarsa decemlineata
  Annotation=GTP-binding protein YPT31/YPT8, putative; Tribolium gene name from OrthoDB database=TC014436; Blast E-value Tribolium Gene vs. Leptinotarsa Unigene=9E-92
tttgtgacaggaacattaagttgcagttatgggatacagggggtatggaaagagttgcctccataacttctagttactacaaatttgctgaggcagcaattttggtcttttccctagataattctgcttcatttcatgtactatctcagcacttacttgatattgttacctacgcagagaatgctaaaatatttttatgtgggaataagagtgacttggttcaagacatcccacaagtcagtgattctgaaatagaagcattttgtgaacagtgtcataatttagtatctggcatatacaaaacatcttgcaaaacgggtgaaggtcttgatgaaatgtttacagacatagcttatcagttggtgaattctaatagatctagatttgaactacaggccatggaacaacatgggttcaagataacaccttatgaagaggaactacaagatgatagttgtttatgttaagatttgaaattcgtcaaaaccattttggaaacatttcggaatgcattcagtatttcaggtttatttttagaataatttcattctgtataaaatccaaaagaaatatcaaacttaaaaagaaatgtattacaatgtcagataagaacagcagtctcatattggatcacaaaagcaatgcttttcagtgtgctttaacttgatttttcctgttttgttttaaataaattaatgggaaactttcatatttatcttgaagaaaatatgttatttaataatgtgtttgatttaatccttcaaatggaacatatgttaacataacagttacctttgaataacaaaattcctatatttatagttagtactgaaacaaatcctggtgtggaaggaatctagtgaaaatattttgcagtaatgcaaaattcttgtttgcacttggaaaaaaaaataaattatgtaaaattataaacaaaaaatgtgccaccaaaaatatcggcttctaaatgtgtgtaacattttatacacttaactaagtggcatgtctatattcctagcttggaaaagctaaacatttataagtataatatgaggttgagagcttttaacttgaaaccttgagttgtgttgcttttttgtgtttattttgttggtataatgtgaaagcctctatattgataacatttttcttgctttgggaagctgagaatattgaattatcatttcttgtttttgtgcattcatattttttacaaagttttcatttattcttgacaaatgaacatttaatacacatctcacttgatggactaattgtaaaacgggatcctctaactactaagacttattaactggtcaaaaatgttgccaaagttttgtaaacattagttaatagtatatatagttttattattaaggctgcatatgaataatggtgtaattttaataaaaatttgga

SEQ ID NO: 18 - DNA, 2106 bp, Leptinotarsa decemlineata
  Annotation=Nuclear protein localization; Tribolium gene name from OrthoDB database=TC005937; Blast E-value Tribolium Gene vs. Leptinotarsa Unigene=0
agttagattttcaattattttattcacttcaccatacattttaaatagttagttaaataaaacacaacttatatctacaaaaaatcaaataaaactcagagattatgtacaagaagatatcaaattcttcatcttaataatccaacacgaatttagaaaaatattcgtatccattttagaaaaattcctcctacgtgtcattttgaaaaattttaacaaagaattcttacagagaacaaaaaccaactttccatcacatgtaatccacttcttttctgctcatcttaatgggatccgctggacctcggcaggttgcacatttcacagttgggattttcagcgttgttaagaaaagtgcaaaatggacaggtccactttggtccagatgaagtgccagctgatgaagtcacactgccagaagccacacttccaggtcttgatggaggtggagagcttgcggcaatgagttgttcgagtgtagcccaatgttctgacttggaccattccacggcagcatctttatctttgttttttaatgcttctagaaggggtcccatgaactcttgcataggcagcatctccatggtagatatatacaagataagatgaaaatcgctgatggcagtgtaaaattcattgaaagcaaactgtgacaggtaagtcgataaggcattgaagtcctgaatgtgaccttctaccagtcggttttctacagggaacggttgtttcgtaggattgctgttgaaggtatactgtggagtaacaggtgtagaggcaggaacatctaccagaaggtattccacaggaagtggacgagccagacgggatacctcattaccatatgaatctttctccttatagtaaacatcaggaacatactgcttgtcagttgattccctaacgtagcctaactctggacaatcttttgttggaatcaggcaattatctcttaccaaagccatgcactgattggaaacttggtagccctccatatggacctgattttttgcatcaccagttacacaaacggtaacaaatttggatccaaatgttcctttagaggcatatctgcaagagttgggatacatattttgatagtagccagccattatgcattcctgagcagacagaaaatgactttcgatgtttcttgtatgtctgacagtacctttttgaatatcttcaggtagaaggtcagtgaaaatccacccaactcgccttaatccgagagattcagctatttgatccacaacctcttctttttcgtctgtaaggagacgaacagaatcacgggaactttcttggggtggttcatagattgctacaacattagctctgatacccaagggaacatctgcatgtatttcatagctgccataaagaaaaccaattctctgatgaccagtaactcgccaatagttgagaaatctttcaactaagttcgtattttcaaaggcaacattatccacatgtcgataagcctgcatatttaatgtaatagcattcggttgacactttgaacaaattccctttggccatggtggatgatctttgcaaccgtttctaatacgacatgaaatatcttcaagtgctaagaacttgccacgatcaacaccagatgtcattttacgcaggaaagcatgaaaagaaaggtgttttatattttgttcccttaagtatgtttcatcgtaaggttccagaggtgagcaatgaacacagcgcgagttagcattgtgacggcacaatttttcatctcttttcctttggatttttccatctaatttcatgagttgtaagtctacaatgtcctctttgatgcttgtactggacctactagtactagtgctaggtctagcattcgatgaaacagaacttgtagaaggtagtggatcatctataggttctccggaaggagtattattagaaaataatacagcaccattgacaggtactagatatatcatatctccatgtcgaagtccaagagttcctaaagtttttgttttgctgctacatatctcattttgcttatttttttctctgtacagtgcaaatgcaaagctgtttaaatcaaaagcattatgaatggtttcaaataattgacaa

SEQ ID NO: 19 - DNA, 1497 bp, Leptinotarsa decemlineata
  Annotation=Zgc:100980; Tribolium gene name from OrthoDB database=TC006359; Blast E-value Tribolium Gene vs. Leptinotarsa Unigene=0
ggtattggctggcaggaagagtgggccagataaagcagaagagttatcggcaattgacagctgtgaatatatctgggaagccggagttggctttgcacattctcctccaagacacccaaattttgattcaaatcgtactgagttactaaaactccttttgacttgctttagtgaaaccatgtaccaaccgccagccgacataagtgaaaatcccaataaatggattctgcacttgacatcagcagaaaatagacatgccctcccgatgtttacatccttattgaacacagtatgtgcatatgatccagtaggtcttggtgttccttataatcatttgttgttcaatgattctctcgaacctttggtggagtctgctcttcagattcttattgttacattagatcatgacacaagttcttctactcccgccgaaagtgaagacgtttctgttcctgacaatctctttataaattacctgtctcgaattcatagggatgaagatttcaacttcatattgactggagtaactagattattgaataatccattagttcagacttatttacccaattctaccaaaaaagttcattttcatcaagagcttttagtttttttctggaaaatgtgtgattataataagaaatttttatactatgttttgaaaagtagtgacgttttggaagtacttgtacccattctgtaccatttgaatgattctagagctgatcaatctcgtgttggtctaatgcatataggagtctttatcttgcttctgctttctggtgaaagaaattttggtgtacggctcaacaaaccctatacagctacaattccgatggatattcctgtattcacaggaactcacgcggatcttcttataatagtttttcacaaaattattaccacaggtcaccaacgcttgcaaccactctttgattgcttactcacaattctagtcaatgtttctccctatttgaaaacgctttcgatggttgctagtacaaaacttctccaccttttagaggcttttagcacaccctggttcctcttctctgcatcttcaaaccatcatttggtgttttttctattagaaattttcaataacatcatccagtatcaatttgatggtaattcaaatcttgtgtatactatcatcaggaagagacaagtatttcacagtttagcaaatttgccaagtgattatggtgccattgtaaaatcgatgaacagaaaagctaagactcgactgtctagttctaccagtaatgataatgtagcagaattagcgatggaaggatcacatccagctttgcctgcagaaccaggaactttgaaggcaactttgccagatacaccacaaattggccaaattactgaaagcgaatcggcacatcctgcagcacaacaagtagaaactttatcaataacaaatggtatggctgcagtaactttgaatactccttcgaaaacgacagttactattggaaatgacaatga

SEQ ID NO: 20 - DNA, 995 bp, Leptinotarsa decemlineata
  Annotation=F-box protein; Tribolium gene name from OrthoDB database=TC003789; Blast E-value Tribolium Gene vs. Leptinotarsa Unigene=1E-120
aacaatgaaatgtacgaaagagattgctggcttcaacgaactagacgaggctgttaaacggctagacttccgaagtgcagtccgagacgttcgtagattcaactacatttgtgcgttactcgaacttttaataggacagcaaatgacagcattgtctggatgtgcacagaaagttctacttgctatgctagaggaagttgctagatatgcgactactagtcaccacaaccctagaggtttccatcaattactcaataatctgaaggctttgagggcagctgagaggtcggcctattggggtggtccgttaggttcccaacttctttggcaccaaaacacttcaaaaatcgaaaaaaatactaaacatggccgcccaaatgcaaattcgtgaaccgaatccagacagctatcccaaattgttgcagctgccagaagaatgtatcagagaaataatcttaaggctgtccgaccatagagacctgaccgctagtgcagaaacatgtgaacaaatggcgtccattgtcggcgaacaaagagtgtggcgggaactgactaagtttcatttcacacctcagcaaatagacatagcaatgccaaagagcaatgatgagactgactggaagactgtttaccatactttgaaaaaaacatatggactaaatgaagacagacaatatgcagaaatgctctctttatgtcgatattgccgatgtctgttttggagatctcttggccatccttgtatcgcggaccaatgccccgaatttcgggccagactacaagaagcaggaggaattacagctcccagtcctgtccctccatcagcctttctaaaatttttctccttgtagctgcctttctaagtcatctatttgttgtgtctttttgtgcattgtgatatatatattatagatctatcaaatgtgagatttttgtgtgaaataggctgctatatatttctcatagaaactatatcttagattataacaaattta

SEQ ID NO: 21 - DNA, 1532 bp, Leptinotarsa decemlineata
  Annotation=15E1.2 protein; Tribolium gene name from OrthoDB database=TC005882; Blast E-value Tribolium Gene vs. Leptinotarsa Unigene=2E-53
taagtttcctgtcatgactgcctagagtaatagtttcaagagattcagaaccccatggatattttacaattatttccactctttgcgaattgttgtcgcctttcttgatatcagtcagggaatatcttcccggccccgctgaaaacttcctccaccacatccttctttgctgttgccactgatggaagaacctagtagaattactcggcggcacgaaaattgtgcaattgcacagtgagtcttcttcgtgtctcatcaagtctttgaaactggtgtttttattgtctctacctttcttgtagtgttcaattatttcatcagtactataactctttttgagcttcttaatatcggcaataccgaaaggtaactatcagaacaaaacgccttcaagtattcataggttccggtaaaatcaccgttattcataattacagtgacgtccttattgaagacaatattatagtaccattctgtcatcagattatgcctgagaatctctccgataggacctatttcgtactggctcatgttgagatgggcgaggaaggttcttttaacgaagccgttggaagtcgctaagttcaatattttatgaagcatggtctctatcgaatagtgggtcttctctgctttctagaggtatatttccgggaggagcgacgaagtattcctcctctgtcaaggcagcgtttttcaaaactgcttctttacagttaccgtcagttatttcgtcttcgcgaaccctgagaggtatgtcttctaggactgatatcagaggctccacattagtcgtatcaacttgcaatatctgatcggcaaattctaaagctgattcaacagtttctattgcttttttgctttcacagtcgactaaagacagtctttcgagtagtgctatcgtgttggcatctattttagtctttgggggtagtttggttgcatcaatttttgattgcaccctctccagtggaactatcctagcaattcctatagcttccaaaggggtttttacacttgaacaaaaatagcgaatcttgactaggtttgatctaagtatttggtacattatcttcgataaaaataagatcttactgaaattatgaataacggtgatcttaccggaacctatgaatacttgaaggcgttttgttctgataggttacctttcggtattgccgatattaagaagctcaaaaagagttatagtactgatgaaataattgaacactacaagaaaggtagagacaatagaaacaccagtttcaaagacttgatgagacacgaagaagactcactgtgcaattgcacaatttttgtgccgccgagtaattctactaggttcttccatcagtggcaacagcaaagaaggatgtggtggaggaagttttcagcggggccgggaagatattccctgactgatatcaagaaaggcgacaacaattcgcaaagagtggaaataattgtaaaatatccatggggttctgaatctcttgaaactattactctaggcagtcatgacagaaaactaa

SEQ ID NO: 22 - DNA, 2575 bp, Leptinotarsa decemlineata
  Annotation=DnaJ-like protein subfamily C member 11; Tribolium gene name from OrthoDB database=TC013563; Blast E-value Tribolium Gene vs. Leptinotarsa Unigene=9E-62
actattaactttaactgtgcataaccaccaaacctatcgcacttcaccaaaattttttctaattaataccaatgtagaaatttgtgggatatttattcaggaatcaatatttggaatattacttaactcttttgcggaaattcctgttctcaaaatggaaatagattctgatgaggaaaacattattgaagaagacttttattcatttctgaatattccaaaagaggccacaaaggaagaaatcaacaatgcttacagacgactcagtagaatgtatcatcccgataaacacgtggatccaacccttaaggaaaaagcagaaattatgttcaacaaaaccaaaagggcttatgaagttctatcggatccccaccaaagagctatttatgattctttgggaactaaaggacttgaaactgaaggctgggagatagtacaaagaacaaaaactcctgcggaaataagggcagagtatgaaaagttagctgaggaaagggccgaaagaaaaaaaaagcaagcaacaaacccatcaggaaatattaccatagctgttaatgctacagatctttttaacccatatgatgatttgttcgaggatgaatatgaaaaagatttcatatccagcatcccgaacattgaagtttcatctatgcaatttactcaggccgtggattttcccttaacgcagaaggatacttgtaccttatcaggtcagctacagactcaaaacggtacgggacagggtggtgtgaatctgagctggcgtcatatattctcacataaaagttgggcagaattggaattgacagcaggaagtggtcctgctatatcgttcaaaggattcaggacattgaccaaaaggttcttttggaatggtggtacgattttgcaattcacacctgatggaataaggccgggcataatgtcaacactggctatgcaaatcgacaaacattcggtaggttatgtatcttatcaaggaggtattagatccgtcttttcaacacaaattataagagacacagaattcaataggttcaatttttcgatacaagtaggtgttccccattcctctgtgcttcttcagtacacaagaaagatgatgaatcaagaattgaagttgaaagttgccgtgaaagctggcacttttggtggggtgatcgagtatggagcagaaaagaaaatttcgaaacacagtaatttagcctttgccgtagtttgtggaataccatctggagtgaaactgaaaataaggttaacaagagcttctcaaatttactctttcccaattcacttgtgcgaagaaatcatgccagcacctatcttttatgcaactgtagtgcctttggtagtgtacgttgttgtaaagaagggattcgtcgaaccttttttgagggaggagaaatccaagaaggtggagaagcaaaagcaaaataattataataagttattggagaaaagaaaggaagctatggcagctcaggagttaatgaacgccacttacactaggatcagggatgaggaaagtaataagaaagggttggtcatcatcaaggctatttatggtaaaataatccgagattctcatcagcatggtgacgaagaaatgaccaatgaggtggttgacgttaccataccagtgcaatgtctagtcaaagacagcaaattagtgatacacgatcacactaagagtgaattacccggcttttttgacccatctttgggagatgaaaaaatgttgcacattatttataactaccatgaccagccccatgaagttaccattacagatagtgaagctctcagattaccaaaaacttcacatcggacgaatataacatagtaccataagagtagacctagtcgaaatagtggaattggatgaaaatggtagaaattgaaacaaaattggtgcaagtttcgtcatttctgtaccatgtgttcaaattgtttttattgaagtgcatttgttgtaaaaaataatttttataaaacaataaagttgttactctttaatttcaattttttatcaatttgtgtccataagatatttcattcgtggattcatcatgatttctttgagaaaattcagtccttcttgccttgcatcttcatgtcctgcagcagtccagctgtgatcggcctctagacgataacttcctagaaaattgtggggagcatttatccattcctcaggggagagcatactaaaatatttctgtccagaagatctttgatataggtgatatgtgtgtccaggttttttcacaaaattacatgctacgtgattcaattcttgattcatcctagtttcagttatcacttcattcattaattcatgcaaattcttcatctgcctacctatgatttccaatttattcgttgcatttgcttttgtaaatgtatctgccttggttaactgttcatccagttccattaactcaacatgtgtctttttgaaaacttttgcaggattgactagagatactcctccaggttcaaaattcctatcaaccaaaactgcactttgtcgttcgttactgttttcattttctgttacttgtccatccatatc

SEQ ID NO: 23 - DNA, 5460 bp, Leptinotarsa decemlineata
  Annotation=Mariner transposase; Tribolium gene name from OrthoDB database=TC006527; Blast E-value Tribolium Gene vs. Leptinotarsa Unigene=2E-50
atatgtttatttcaaatacactttaaaatttacaacataatatgaatacggaaaaccactttagaacatagttcaagaaaacattgtgctaattttgacttgagatcacattcaaaaaacatcaaactaaaagtaaaagtataaatatataaaaatgcgacaagtaatatacaacagaagtgaagaaacttcgtcttctgcttagaaatatacaagagaaatgcatcaacctaaatgcaatagattatacagtatcacaagtttataattatatatcgattaaaactcctttcaatagtgattacgtcccatttatacaaatcgctcaccgttggaaaccatttcaacaaaaacttagaaaacagctgcaaatataaacatcattatttttcaaaaacatccatacaaagtattagagaaaactctacagtatcagcgggatgactccattaaaaacctacaaaaaagctacaacattaaaatgaacatatacaaatcatatgtcgttatagcaccagtctccaagtatcagcatgtcaacaaaatcagtagaatctaaccctaaagatacttgcaagtatttctccagccatcaattttctaaatttcagaagtggggttcgttataatttgttggaattgattatcaagtgaatatctcttacgaacttgttcgatgcataaacatgtgtcatccacttggaatacttgtgaaattataaacttctacaataaatatctcaacaaatataagactaggatcgaaaactcgtaccaaaaattattcacttcgtcatatgtaattttttacgaatgattcagaaagctgttttcaaatacttgtcatgagattcaaaaactgaaatctcgaaaatgaaatagtcgagaatagtaagtaattaatttaaaaaaatatgcatcaactgaggaaaaacgttttttctaactcagtgtcaaaatcaagaacttcggtggacatggagtaatttcttccaagcatactctgtatttattttcttgcgaagtcagatttcaaatggatctttttttcaagaaatattaacagacactcctgaaattttcgaaaggcaagagatgttgaaatataatgatttatatatgtgtaaatcttcgatgtaatgacgtgatttgacactattctttgaagctcctaaatgaaatatatactattacacacggccatatttttggagcaacttatgaaaatcaaattatccaagtgttatatcatcctcctcctcagtcagctccagtaaatacattcattggcactagctcccatctactgatgaggtattataaacttttctttctgaatatcaattttgattgaattatcgggtgcttgaagtaagaataaaatatatcaattcgactgtgatacaacaaaatcctggaataacatagtctatggaatcccttaagctctaatgatatatacacattgttacgcagtattttatgtctgtttgcaaacagtacgtttatgaataatatttcgatagcaattcttgtgagagtcctaacaaaaaaattaaattttgttatttgaatgatggcagtgttacaagacatcagattaacccgtaagcgctcagggttagcaaaatagcgagtgtaagtagagttcagttcaatttcgacactgtgacataaaaggtgatgtgtattttacagtattaagattaaccttagacttttgatttgtgtaacttaatattacattgaaattattcaaatatgtttgtagaaattcaaaaaatagacaaaggatattcatatttttcgtgggggtgttttatttctaaatattactaaatgataatatcaaatgtcaggcaggtcagtttagccaattcggaaagagattactttcgctttttcagctaggagttgcagaaattgcatttgtgttatctgatagaagagtctttgtagacatagggcgagcaaaagatctgatagtattacggttatgcttagataactttctgtactactacatgacccaaaagtggtgtatgaagaaatgactaattttatcaacatctttgttttgattagctgtcttattgggagaccaacgttacaggaattaaattcaatgtgccatgaccgatattacatatatcaaggcaatcagtacaatcgaaatttgcaaaataagacaccgatcgacaaaataaaatatcatttgtcacattttcgagcagaagaattgctctgctgtggagaaagtggcaaaatatgatggatagcagaataataaccaattcaacagaatattactttgtcaatgcaattttctggggtttttgcagtggtctgccggtttttatgtctgaatatggaaagaattgggaagaccttcgacctctaagaattctgtagcagtttacaggataacagatcaaggatgtttttctggtgtacatactaggtgtgatgaatgtgaaatacaacacacatttcaattatcaaactatttttcagtcctattctgcttccatagttttcaaaaaatgaggctgtctatcacaattctttatgtttaaatgacacattattcgtgcctagctttatcatacaatatcagttaatctgcctaagagaaatattagaacattttgtaatgtcaaattatccaaaatatcaaatcatagcataaactaagctaattcccaagtttccatatttttagcgaaaatgttcatcagaggctttcatttttattaatgttaatattttgattatttaatgatactggaaaaacaaaccttggcaattttgtgattctttatacgagggtggccttttatgtttcgggatttggcaatcctagtgttgcaatctggtaactgacagctctatcgtaaagttggacatttttgagcttatatgttctcagaacgttttaacatacgcgcgctatttctgttgtttacagtaactgtttgaacgctctgcatttttgttgagttttcgatacgttttttgtgacgaaaatgaacatcaaattttagaaattttttttgacgcgattttcgtgtaaattttgcattatttttcgtagcacgttacaatgtaaatcatatgggtcctgccgtgacgtgtctgtctgcctgaattatttatgtccacagaaaattcaaatctcccgccacaatgatgcagaagcgtgcgctctgattgtgtgacaggacaatttggtacactctggttcgccgatgggtgggacaccacgtgacaatttggttgactggatgccttgctgagaagcaacctggctgggtgatgacgtcaccgtctgcccgaatccgggccccttctactacgaagattcatctcgacccaaaaatagaattaaatcttgaacattttcgtgcgattattttttacaactttcgacgtgaattaactaagcaacagtgcatggatgaacttaattcaatttttggcgatgaagctccatcaaggaccagtgtttatcgatggtatggtgaattcaatcgtggtcgtagttcactccaagacgaatttcgtcttggagtggagttgttgttccgaaaaccattgatgctgtgcacgaactgttattaagacaaccttaggcataagtgggaccagcatacattcaatattgcataaacatttgactgtcaaaaaaatttgttcgcgttggatcccacacaatttgtcaatcgctcaaaaaaaggctcgtgtcgattggtcgaaggaaatgctcaaaaaatacatcgcggtgcttcgaaacacgtctatgacatcgtgacaggtggtgaatcgtggatttacgcgtatgagcccgaaagtaaacaccagtcgactgtatgggtgtttcaagatgagccaaatacaacaaaagttgttggcgcatgaagcacttccaagcaaatggtcgcctgttttttcggaaaaactggacatgtcgcaaccgtaccactagaacaacgcagaacagtcaattctgagtggtacacaaccatttgtttgccagttgtcttccaagaaatcaggaaaaccaaccgccgaagacggatcactcttcaccacgacaatgcgagctctcacacatcggctcaaacaactgcatttttgagcacccaaaacatcgatttgatgagtcatccgccgtacagtcctgacttggcaccgaatgacttcttttcattcccgtttacaaatgatacaagctttgtatggaaggtcgagaagaagatgtgaattacgacgctctctctagaagccccagcatttcaacaaccgatggaagtgttgagaaagtgaaaaaattgtttggagaatcgttgaatcactatgagagaagttactgaggatgtcagcataaaatttgggcatgtagcgtgtggcagcgaatttaattcctaattatcttcgggagtttatgtcatatggtcatacggtcaaaaaggagtattatcttgaaattaagcgccgcttacaagaatatttttgagaaaaatgaaaattcattttattctttgaacagactcatatatgacctgaaaaactcgaacgtgaatggctgactaactgaatcaagacatattgtttgcattaaaaagtatacaatggattatagtagagatgtggattgtaatgggccattaaataatatattcgagtaatgtgatggtgaggtaaccataacccgaatggggaaccaataaaccaaaatcaggctatgggctattgtggctgttcaactttgccactaaaattattttcaacagcaaatttaagccactacgttaaattttatttggatgggatttgtaactagtggaaaaaatgattcaggaattatattattgctttgtacaagctatgcaatcaattgtgactctattctttgacttctcagacaagaagtcttgtagataaattttccatcagaatccgtcagtctaactctgaccccctgcatatatatctgcgtctgtagacttcggtgttattttttacaaaaataaacgaaacctatcacaaactcgtccataatcgagttccttaaatgactgtttcactgcccgacctcatgtgatgcaatcgaggttgttttctatggggatgcgacctcgacgagtgcttggaggtggtactcaagctggtggatattgtctgcgccggcatgtatctcattacttgcggcatggtttgtactttcagaggggcctgcttcctgggtcccaatcttctcagaaccgctcgccatgcggtcacgctcttcatcgaccaaatccagaagacgctgctcactccgatgaacaagaccatgaagtatttgagcaagaaagcccacaatgccggttttctttcacctgcaagccactggtccttgttgttgtattcgtagtatatgcttgacattacgcaaaacgtaggaatggtgtacagagt

SEQ ID NO: 24 - DNA, 6657 bp, Leptinotarsa decemlineata
  Annotation=AP-2 complex subunit alpha; Tribolium gene name from OrthoDB database=TC010798; Blast E-value Tribolium Gene vs. Leptinotarsa Unigene=0
ggacgtttcttataatagaagatttgattgtagggtgttccatttcttaccacaattagttaatttgtgaaggaataggaaccatgccagcagttcgaggagatggcatgcgtggcttggctgtttttatatcagatattagaaattgtaaaagtaaagaagcagaaataaaaagaattaataaggaactggcaaatatacgaagcaaattcaaaggagacaaaactttggatggataccagaagaaaaaatatgtctgcaagttattatttatatttttacttggccatgacattgattttggtcatatggaagctgtgaatcttctgtcatctaacaaatactcagaaaaacaaattggatacctgtttatatcagttctagtcaacactaacagtgagctcataaagttgatcattcagagtataaagaatgacctggcatcaagaaatcctattcacgttaacttggctctgcaatgcattgccaatattggaagtcgagaaatggcagaagctttcggaaatgacattcccaagctgctggtatcaggagatacaatggatgtcgtcaagcagagcgcagctctctgtttgttgcgattgttcagaacatcgcaggagataattccaggcggggaatggacttctcgcatcatacatttactcaacgatcaacatatgggggtcgtaacagcagctacaagtctgattgatgccttggtcaagaaaaatccagacgaatataagggatgtgttccccttgcagtttccaggctcagcaggattgttacagcaagttatacagacctacaagattacacatactattttgttccagcaccttggctctctgtcaaacttttacgtttactgcagaattacactccaccagctgaagaccctggcgtaaggggaagacttaacgaatgcctagaaacaattttgaataaagcccaggaaccaccaaaatcgaagaaagtccaacattcgaatgcaaagaacgcagtattgtttgaagctataagtctcattattcataatgacagtgaagctaatttgctagtgagagcttgcaatcagcttggtcagtttttgagtaacagagaaaccaacctgaggtatttagcgctagagtcgatgtgccatctggctacctcagaattttcacatgaagcggtcaagaagcaccaggaggttgtaatcctgtccatgaaaatggaaaaagatgtgtccgtacggcagcaggcagtagatttgttatacgctatgtgcgacaaaagcaatgctgaagaaatcgtgcaagagatgctgaattatctggaaactgccgattattcaataagagaggagatggttctcaaagtggccattcttgcagaaaaatatgcgactgattatacatggtatgtagatgtaattttgaacttgataagaatagctggagactatgtatcagaagaagtctggtatcgtgtcatacagatagtgataaacagagacgaagtccaagggtatgctgcaaaaactgtattcgaagctttgcaggctccagcttgtcacgagaatatggtgaaagtgggtggctacattcttggtgaatttggcaacttgattgcaggagatcaaagatcttccccttcggttcagttccaactgcttcattccaaataccatctctgttcccccatgacccgtgcgttactgctttctacgtacatcaaattcataaacttatttcctgaaatacgaacccaggtacaggaggtgttcaaacagcatagcaacttacgctccgcagatgccgagctgcaacagagagcgtcagaatacttgcagctgagtatcattgctagttctgatgtactcgctacggttctcgaggagatgccggcctttccagaaagagaaagctctattcttgctgtgctgaagaagaagaagcccggaagagtgccagaaaatgaaattaaggaaaataagagtcctactccagttaccaatcataccaatgatgtaaacaacaccaacaccaactcagcagacctcttgggactatcgacacctcctacttctcagccaaattctggcaacacaggcgtgcttcttgatgtcttaggcgatatttatagtggaaaaccgattaacaataacggtaccgtgtcctccaataagaattggattgttgaccctaagaaatttgtttgtaaaaataacggcgttctgtttgaaaatgacctgatccaaatcggagtcaaaagtgaatttcgccagaatttgggacgtcttggactattttatgggaacaaaacaagtgcgcctttacaaaactttattcctacgttattgtggccagaagaaaacgtttctaaaatgagtatacaaatgaaaccagttgaaccggtattggaagcaggagctcaaatacagcagatgataaacgccgaatgtattgatgattatacagatgctcctagtatagtgattaactttgtatgtaataaggtcccgcataaaataagcataaaacttccccttaccataaataagtttttcgaaccaaccgagatgaacggcgagtcatttttcgctaggtggaaaaatcttggaaataccaaccagcaaaggtctcagaaaatattcaaagcttcagcacctatggatcttcaggcagccagaacaaagataatgggcttcggaatgcagcttctagacggcatcgacccaaatcctgataattttgtttgtgcaggtattattcacatgcgatcacagcaagtgggatgtcttctacgcttggaacctaacaaaaatgctcagatgtacaggttaactgttcggtcaagtaaagaggccgtttctgtcgaattgtgtgatctcctagctgatcagttttaagcgacgtggaagggtcatagaaaatgtgtgcattccactagttcataaatgtaaatgatcatcttttataattttaaaagtgctatattttgtagttgtccttgaagctttatcaaatcgtgtcgcaaatataatttagtagcagtggtacaacctcctgatattagatctaaaacagctgttactatgtggtaacatttgttgtgttttgttgtcatccagatttagttagtcattcctagttagttatttactatctctgcgtgcgggaatgacgaatctggaataggtttagtatgaacaaaacaaacctattgcacgggttaaatcagggtcaaaaatgttgatgtctccctctgtttgatgggcaattcatataccatttgggttgctcaaataacagtgcttgtgtgtataaatgaatggcaatggtctctcccctaatttgatttgtctttatatacataaatccagtagagaaacttcacagtctaatataaatattcgtttcagaaatatattttcaaaatgtataggttaggtatagttgttcttctaatcagttgaatgtttcattggtccatagttacaatgttattataagatatctttcgaaatgatctactcgaaattccttgtgaaacgaataaggaaaaataagtacacaatgcaaatgaatcttcttgcttggtgaccaaatagcgttacaactctaaaatgattttgatatattcattaatagtataatgttatttttctggtactttgacactaatctttgttccactgttaccaatgagacaatataacaaaatgtgtgtgtgatgttcacttgtatatttctagaaatataatatattgattttattcgccttgtttcagttttttacatgaatatattgcttatactattcaaaattatacatttgttaaagtaagatgagattttcatggcatttcaattactctcaaaatatatttatcgtcttttaatatgagaagtttcaagacgtacattaccaaagcaactaataaactttttgaatattgtctgaatgttatttggggaggtacttcaagttattctgatatttatgggttttcactcattcaaaataaaaattgaaataaatcaaatatgaaggtcaaattattgaatttgcccagtattattgctgcatttgaataaaattcaggtattggaatttttcctacttgacagtaacaacctcaactgaaatttttgcttgaaattctgaagcaaaggaacacgggtgattcttgaaacgttatctaaacgataattgaagttatatactgaatagaagctaaacaaagtagaacattttgtgaatcatcgtcataacaagatcgaagtttttcagtgtttttatttcatgtcatgttccatcaaaacaaactatcaaaaatgaccttataaagcaagtcactttaataaaatttaagcgaaatggcaaatatttattctttaatatacagtatcattagtagtaacatcattgtgtggggaagagctacatacacatgcaaaatgttcatatcacaaaaaaaatcataaagttaatatatcatttggactatagagaaacatgttcattgaaaacaatatcctaatactaacatctatctatctctacaaattaatatatacccatcagaatgctaaaaatatgaacagaaacagtgactaccatgaatatgataccagacagaagaatgacttccatttgcaccacttgcaaagaaagcaacatataaagagccctctatatgatggagcacatttatttgttcaatcttttgcctgaagacttgaaactcattaccaatatgaaacatttaaaactatctttgaaaaagtttctcatctgccatgccttttattcattagacgagtataaacaacttcgtgactaggcagttatgtttcaatgtatttgaacatgtgtttatatttaaatattttatattttatgttattcttattattcttaattaatttgtaacaagtaggatgtttgtgatgtttttttcttaatgtttatatccaatgagaattttttctctctttatgtactgtgacttatcacatgttcatatctcacgattaaataaatatctatctatctatttaatcatattggtataaaaactaccaattcttctccttataaaaattgtgcttcacttatttttttggtacaaactgctgcactacacagtaaaaatctcacattttactgttgcatagagagaacaaatcttttatcggaccctataaaattaaggtcaagtttttttctcaattctatcctatattattatcgttattactgctaccaatcaatttatttactgtgctgatcttttacgtgatgtcctataaatgagtgaatccttaaacgatatgttaataatttttttattatacgaacatatcattccgtcacaggataaacgaaatatcggagacataaaaaaaaatttgaagtctgaatcatcactcgaaagatttagaaaaaaacggaaaagacactgtatgcatacaaaacagaagtgactgcttatcatatcataacctaacctaatgtatttgcaactactatctattactaatttgtaaacgtagcaataagttgttttttatatgtcctttcccgagtgtcgatattatcgaattttatgatggaaagtttagtttctgttcattaacaattcttttaagtgacatatcttcggtattatttctgttctgcatttttatgaaattttatagattctacgagacgatttgctgatataatgttatgattgagagagtttatattatttatctagtgtttccctaataaatttctataaatcaatgacacgattccagagcaatatctcatatacttctgtcttctaatataatgattttggatttgtagttacccatatttcttagttaatgttgataagtggaatttcagaacagacattttttttattattacgttaacctcagaaatacaaatttaccaaagtatcaatcgtatctaactacaatttttaagagttttaaatttaatatgcatgatctcgatgatatggtactctctgaattcggaaactataacatattgggattcaaaaaggaacttttcgacattttgttttcaaatataacgtcaaatagttgtttttcttttttggattcaaaaatgaggatattattattattaattttttgcaataagtgttactgacaagctgtataaatctcctgaattttttaagctaattactgaaaatgtttttcatattcgacttattttagaaagtattttgattttaggatgaatacccacaaatgtgtagaataaactttctaacatcgactcaaaaatcaacttttgtaaacacagtttgaaaatatttcatcatttatcagtttctagcaatattttcatgtataaatgtaatacctttgcatggagatctgttctaatcgaatttggtaactgtgaatttttctgacatgtagatttatcatagataaagaaatgtcgcttctaagtatcacagcaggtataagtgtaatgtataaaatatgtcacttctacctgataatttagcttatcatatttttctaatttgtagatttttattatttagagcattcagttattgtagattatatatattatatatatgtatgtgtgtatatatgtgtgtatatatatatatgtatata

SEQ ID NO: 25 - DNA, 865 bp, Leptinotarsa decemlineata
  Annotation=ER protein reticulon; Tribolium gene name from OrthoDB database=TC008387; Blast E-value Tribolium Gene vs. Leptinotarsa Unigene=2E-106
atagctgagcggtcacacgtgtatgctctgttggaacattttcggtgagactgaaaaatgggtaggaaaccgaacaggtaccaaagatattctgatgatgcggagcctttacctgaaagaggacccgtggaaagtttaatctactggcgcgaccctaaaaaatctggacccgtcttcggaggagttcttttagtcctcttatctctcacctacttctccctcatcagcgtggtggcatacctttcgctcttagctctgagcctaaccatagcgttcaggatctacaagaatgtagtgcaggcagtacaaaaaaccggagatggacatccattcaaggactttttggagatggatatgtctctgccccaggacaaggttaaggaaatctctgaggtgatcgttgcccatgtgaatgctgccgtcgttgaactccgtaggttgttcttggtcgaagatctcgtagattccatcaagtttggagttttgctgtggacgctcacgtacttgggagcttggttcaatggaatgaccttgattattatcgcatgggtcgcacttttctcacttccaaaagtttacgaaacgaataaaactcaaattgatgccaatttggaaatcgtgaggactaaattagcggaaatcacaaccaaaataaaggcagctattccaatgggaaagaaatcagaggagaagaaggagcagtagattttccacctgcgtgactagtagaaaattctcccgaatttcacaaacaattttgtttattgtttttattccatccttaagaaattactctcaattgtactcgcgtagtacaattattgtatataagctgttattttaatcattgtattttattcttgtt

SEQ ID NO: 26 - DNA, 1333 bp, Leptinotarsa decemlineata
  Annotation=Calmodulin; Tribolium gene name from OrthoDB database=TC015439; Blast E-value Tribolium Gene vs. Leptinotarsa Unigene=3E-43
gacggtactagtaattcacaggtaaaatattttttagtcatatttacttcaaattcacacacctaatggtttcataaggtaaccttcagttatatacttcagattataaaactagtccaagtggattaaatacaaacttcgttaaatagggtcaatcttgaaaagtcctttacaaatttcttctttctaaaaatctcaatcctctattggaaaccagaaaatgaatcacattcacgattctcatcaaagggtggtatcagaaatggatatatttcatcaataatttgaacaaactctagactaaaaaatgtaaaacctacaattcaagaattgaaaaaaattcgggggatacatactatatagtaagtgcacagatgtattcttgtatcacaaagtatgaaaaaaaaacatggctaattttgtatcccctgaaactaacatcaaatagaacaataattcattttcggaataagtacgttttcataccttgtgagtaactttaaaatttcaactagacacgaatgtagcaatgacttgaaatagcgggcaccttatattgaaggcattcccgaccttccaagaactcaaaaataaatatattacaaaaatttacacaattatattaatttataaatatttttattaattaaacatgtcttgtaaattaaataaccttgaagttattcacttttaatgggcccgaccacaaagcaaaaagttcgagatgttgaaaaatgtagacattgggccgggatgaaacaatggaaagctgaaaatgcatctgttgattcttcactttgaagtcatcatggtgacaaactcttcgtaattgacttgaccgtccccatcgatatcggcctccctgatcatttcatcgacctcctcgtccgtcagtttttcacccaagttggtcattacatgacgcaattccgccgcggatatgaaaccgtttccgtctttatcgaatactcggaatgcttcgcgaatctcttcttcactgtctgtatctttcattttgcgcgccatcatcgtcaggaattcaggaaagtcgatcgtgccgttaccatcagcatctacttcattgatcatatcctgtaattcagcttctgtaggattctgtccaagtgatctcatgacggtacctaattctttggtggtgattgtgccatcaccatctttatcgaacagcgagaaagcttctttgaattcagcgatttgttcttcagtgagttggctggtgcactttggtgagagacgttgttggtgattcctttgtgtcgacatattcctgtttggtgttctaaataatcctaaaatatcacaatggcagacc

SEQ ID NO: 27 - DNA, 3479 bp, Leptinotarsa decemlineata
  Annotation=Ventral nerve cord defective protein; Tribolium gene name from OrthoDB database=TC008368; Blast E-value Tribolium Gene vs. Leptinotarsa Unigene=6E-12
gggcaaagataggtgatgtattgataaattactatcaatcagaacgcgtcgtgtgttgttggagtgaaagttgtcgaaaaaaatcgttctcttgtgctttacatcatgtcggggtacgaggattatccaccctacgagaacactacttggcatatcatacctcccgattacattcatctggaagaggaatatagatacccattattagactctatgaaaatgaccggaacgactatggtcaatcaaagacaaccaggaggttttgccattagtgatatcttggaattagatcgacaaaacagcgaagaaattgacccaatttcgacagacacctcaatgtactccccccatcaagacattccctatccaccaagacatcattggattcaaatgccagagtctggtttacccccaccacaacaccaccaactaacgatacccacccaccctgcccaactcagtccagacagcacgagtccagcaatttccgaaaggtccagcgtggaacccagttgtattcccgaaaactccctcaaccccaacccccatacctccgcccctccctccaacgaacccatcagcgataacgagatagaagattctgaggacatcaaagaagaacaagacacgatgttgggaagccacaaaaaacgcaaacgaagggtgcttttttccaaagcgcagacctatgagcttgagaggcggtttagacagcagaggtatctctctgcaccggaaagggagcatttggcgtccatcatcaggctcactccgacgcaggtcaaaatttggtttcaaaatcatagatacaaaaccaaaagagctcaacacgaaaaaggaatgcacgagcagcaaaacaacccattgccatcaccaaggagagtagctgttcctgttcttgttagagatgggaaaccatgcatcaacggtgcgcaaaaacccgaaaatatgccattacctggacccatgatgatgggttcgtcccatcatctactgtacgggcaaccaagagcgtggtggtagacatatactactttcaagtactttctatttgatttcaggaagcccaaaattctttctggaattgaaacgactcgggtagaaaaacgatagaaatgggcattctttttcactgtaaacagttatacctcaaaatatgaaaatattttccaatttcgacttcacttctcatgttcatttttcttaacaagttcatatgtccatatgataaaacacatcatttgaatttttttgtttgggcagtgcatcgaaatattaatataatgcagtacactagtatactgatttcatcagatgtatgaggttacaatcttaatcctcatatgttcaaatcaaatacctacaaaaaattaattaaatatgaagaattgaagaagtcgaatagatgaatctactgtaaacacttttaacacaccagaacaaaagcactgatgcgcgcttcgctaaatatcaagagacgacaaataataagtctaaaactaattaatacagtttattgtatgattttcacttcctcaagcgtaaacttgtatacgcttgaggaaggtattgtatagcgaaacacgtgtcgcggtttttttaaaaccttttatagtgaaaatcatacaataaactgtattaattagtttcaatatggattttcatcaagtatcgaccagttctattgaaaataagtcttgcagctatgctagatatttgttatatatatggacgaaactgacattaaagtagcgtcattgaattgacttctcatataaaatattgtgttatttttttatagtacgagggttatcaaaaagctgtttggaattggacctttctcaactgttaaaggcgtctaaaagcctgttgttatgtacggttattacaatacagtgacaaaattatacaactaatactaagaaataattcaataacacttatgcaatgttaggtttgttcagatgtatatctaatatagctgtagttttagtcatctgatgatggtaacctggattgaaaaattcgcgttaagagagtatttttgttctggcgaggaaaaaatgttcttaactgcttcattttacgccagaagttcgaattcaatggactttattcaactcaaaatgaatatttttttggtaatcactgtaccccaacttcattattttgtgtgtgagaaaaaaaaacacaaaataatccacgatgaaaagtattgtggcaaaagctatgaatcgacatttttttcgaacttttggttctcacaagtttcagatgagattaattgttttcttgagaaaaacggaagcgccacgtatatcaattgtttgtttcttgaaaattacgacttcgacactcgaaattgagaatttaaactcgaaaattcgatttaaatttcgatatttggagataatagtcgaaattttgagtttcatagtcgttatctccaagaaacaaataatataaaaatatgtggccattctgcgcttccctggaaaacatcgtgtcttgtcagtaatatcttttgtcgatttctatgaaacaacatggaatatatttgaaatgacttctcttttttggaatatctggaaaggttatcgttgttttcgaaataaagtgtaataatgttatcaaaattagctgtttctacggatcaaatattaccgtgtacttttgtactgagataagatttcatacgtgacactcttgagtacattctcgtggcttatttgattatcatttatttcatttgattactgagggagaaattttatttccatctcgcagattcaacctatagatggggtaccaatgtgaaatgtttccaaataatacaaaccaagagatatctgaaaatctgtgcttgataaaggttgataccgataatatttaataattattttgtgaaagaaatcgatattgatagcactcaaatgtttcgacattttctatcaggacaattgagattaataacacaatttgaatctttgattgatattcaaaactcagtgtaagtgaaattcaatatattatcatatctgcaaaatatttatcgatctttttatatcactctttgaacaaaatttgaaattatcagtgactactccttttccaacaagaaattgagtcacattactttgataaagtttttaacagtcacgaggaagtacttgaactttatagaaagccttatggcctactttataaatctagtcaatagttgtttaattatatttcaccatcgtgtgtcaccgttcatacccttcacaataacttttatacttagctgtatgaagtttttctaaacattttgtaaataactagagatagaagtgtatatgtgtaaatagttgaggatagatttgtgtatagaagaatagataaggccaacaaactttactgactgtgttatcgcactatttgttttcttctggtgtacaaaaaatatttattgaagacaaataaaagacattatatta

SEQ ID NO: 28 - DNA, 2310 bp, Leptinotarsa decemlineata
  Annotation=C2H2-type Zn-finger protein; Tribolium gene name from OrthoDB database=TC007176; Blast E-value Tribolium Gene vs. Leptinotarsa Unigene=1E-167
tatttccatctaaatttattttccaaaatatatttttatacatttttatttttacataaaatataaaacaaacactttctcaaactttctccataaaatacctgatcatgtgtagaacaaactgatgtggataaccaaaatatgtttcacctaattatagagtatcaacataaattatagaactaataaaaatacttcaaaactgaacttgtcttctgaagtgtttctggagaatttggttgttctttagtcccattttcatcttatatttcgactggatccttttgagataatggatatccctagctttcctggcagctgctacttgttgagtctctgtccaacccaacgatctatactgagccagtaccttatgcagttttttactatttgacggaactgcaacagctcggtttggatttaagctctgtttatagtacctcatgaggcttcggtgcccaactgtgactccagatggtagcaccagttggtagtcagaagtatccagttcatctacagagacctcttcatctggatcgatgtcgtgttcagcatcaggataagaggaggaataatcgtaaaagtctgcatactctgctaaggccacaccttcatgaatcattttgcagtgtcctttgtccaacatgtgctgcctggcagaatcagccgaatgaaaggttttacccttttcattgcaccataagcacatgaatccatcagatattttctcccccaaatatttcaatagaccttccacatctgtgcaatattcaatatctggtatgaagaaggaatgggcaacagtcatatgttctaaatttttcaagaagttacgactgtggtgcaaacagaaaatgcagtcattattatctatgggattttcggtatcgtcttcccactcgtcagaatcaacttcttcaacttctgggtcatcttccatgttacttgcaacttcctgatcatttccattctcggaactatgagcactcctaaattcattatccttatgcttttttgaattcaagtgattctcaaatgaattctgattgtggaacgacttttggcaagatgaacaatatatgtcttcatttcttttagaaacatcatcggcatttctttggttcaacactcttgtctgaaactcttctgctgcaacaggaggcagttctgcaatttttcttttaagattataccgatgccaatctgttttgaaatgctgtttgtgtatttctgcattttggaataataccatacaagtgtgacaggttaatgaattcattgtggaaatgtatttccttgataattatcttatcttctcttgaatttttataacttctataaacttaacctctctctagctctcgaagttcactcacttcactcaaagttcttgacctttgcttccagataggtgcatttagccagctcgattcggatgattacagcttggtctgattatgaaccatgctgtaatccaagacttgttttcttaattagatttggaaataaaactattgtcttcttcataaaatagtattgttgcgatcccactcccacgtggacattcagtgtccggcctccaaccggcgtgaatgggagcaggtattataaatattttacacaaacacaaacaatttttatttaacactattatttttacgattgctggctcgttataaaacagcggatatcacaacacaaactcagctctctaagttaatggacgttgcttcccaatcttcccactcgggcgcatttgtccaggctcctcctatcaaattgacgtcaatttgacagaagcttcgtcggggggcgcagcggtcttgctcgaagcaatgctgccaccccttttttatcacactttttataataaaaaacacagtattttttttgtcgcctcttgttcaggagaccttttgtttttttttacatatatttattgggtcgcctcttctactggagacattcggattttcaaattcacatatatggtccgtttacgtggttatccgacccaccccggcctgaataccggcgtgaataaaggggcccgtaaacttcacttcattaaaaactctcacacatttcaatatttattcaatggactagcacaacacaaaacggagccccacgatagcacatggcatccgcgtaccttctttgtggacggacgttatcggcacgtccgtccactaccacggccaccacgagactcccgcccttgacgtcattacaaaattcctaagcgatgcttatgcaacgtttcataagattgataataattctgaattttgtttttccatgatttga

SEQ ID NO: 29 - DNA, 7490 bp, Leptinotarsa decemlineata
  Annotation=Heterogeneous nuclear ribonucleoprotein 27c; Tribolium gene name from OrthoDB database=TC016215; Blast E- value Tribolium Gene vs. Leptinotarsa Unigene=2E-146
ttttctcatttagagatatttaataggtacattgttttgtaagtattttcataatctaaagacatcttaattcaggctaaatatattcaaatatcaactaccccattacaaatgaactactataaatacatacatgtatgtgtatatatatatatatataaatgtatgtatgtatatgattttatactcgtattatttaaattttcaaaaacaggcattagttcgcttgaagtactctgttaacaattacttttttctaacagatgacctcgacaacctttacaatacttttcaaagacttatttgataatgaaatttgcttgcaacaggtcaacacgtacaaatctataaagctgatttacagtggtagaggacaatatgagttcagtaaaatgtatgaagaagttaaaggagggacaagttatgtgaatataatgttagcttaattattaaataacatgtttgtcaataactatcaggcttaagaattataaaacaatgcaacactcaagtcacactcatatattgaatatacagtttcattagatcattgtcggtagacataggatttcttatagataacataatacaaaataatatcttttgagcaacaaatacttcacaaaaattgtatgttttatagaaacatacccttatgttaaattatgctaaaaattatgagaatacctaatgtaatgtactatttcactagataaaatcccataagaaattgcactatatttaagggtcctaaatattttaaagtgatttattgtatatttttcttttaatttaaaacttagccagtacctgtacatcagtcgaattcttctaatttttactcctctaaatttataattacactaacaattcaattaactatgtcagtaatggtaatataaaatacatttcataaataatctattattaatttgtagatttattttgtattagtgtaatatctaagaactaatgtaatttaaataatacctcttcattagacataaatgtatattaatatattcgtgtgtacaatgaacttcaaatacttcattacaggaagtagaatgatctacgtagataatgaatttttttttataacaggccccaacttgtaactactcaagaactaaaaaagaattgaataggtgtttgaaatgttcatcttgttcaaaagattatttttgaaacgaggtatttcatatacatattgaggataagatataattgttactgttctaccgaataccttgtctttttccatcttcaaatattgaaacagtacctgacactggtcaaaatggaagaataaacaagatttaattatgtgcattaattcatagaatatgaataacagttcgaattgtggtttatatgtatttacaataactcccccaccataagataaagggaataaattgaactaatttatcaacaactattcaattagactaacgatataacttgacatgtgatgaaatcaaaacaatttaaaatatagctgctattgaaaataatatatcaagaatgagaatgatgaataaaactggaagaaataataatgtcccctcggttaagtctttaaacgcattattttaagttttttcaaatcagacaaatgaatggacgctaatcaggttcgtaaccactctactatcattgaatcatccccatgttttgtcaaatttactagattaaaaactacaatctacttagagaccgatttgtaatttgtaatattggtctgaatcaaccgagaataattttcgactaaaactagaaaacaatattcttttacttctaaactacttacgaacattgcttatgtagattgtcacaatcaaaattaaaaaaaaatatataaaatctggataaataacatcaattacaatgtgattagatagacagacaaggcccagacagacagaattctcatatactaaatattaattaccttgatttcataggttacttatttttctagattattttcagaaaatgctatgtctcttcctgaggtatagtggtgtgcaaaactgaggtgactgcaaaaatttatttcagacacgttaccttggacactcaaagaacaaactgataccagtgcagaaaattgaatgtcccaagaaaaatatttcagtaaaatggtaaactcgtaacactgtaaaacaattttctacagatcaatatttaaaaataaccaaattttaaatattcctttgaaagacattactttcacatatatacaaaataaaataacttgttttgtgagtttgttggcagtggtctgctaactgacattaccaaaggcaatgaccaaatagaactccaggaagatctttcctccgaacgttaaggagaaatccaaaaaagttgaaatggtaaagaaacagccataactgataatatactatgatcataaaagttaaattaattcgattaggaagcagttctcgaaatatttttcaaaatatacaattttcctcctaaacctcacaataaaatcttatattgtaaaaataaatatctggcattagtttgctcaatatcgtagagatattaatacttgcgttgatcacaaacactattcttaaataggtaggtaacctaactgaacaaataagtctttttgaaatgcttctagaaatatgtcaacaattataaaatgtaggtttatcctattttatgacaatagattttataaaactaaaatgtatttttaaaaacattctcatattcgagtttcctcccaagcattaaggaagtaaaaaaaaagtgtttctgctgaaataaacgatcagtcgaacactgtcaccaacagacaattggtagaactttgcatgtaagtgtaaagatagcaagtgaaacccaagtactccctctctcaaaagtgtcccacatatagttcaactattttcaatgaagtatacttgatgtttgaatctttcaaataagttagataaagcagaatttaaaacatattttgatgcatgtcaaaaaaatatttacatccaaatagaatggattcaccaaaaagtaatacttaaatagaaaattattttgataacaataaaatatataaaaagtgaataaggtagcttattaaacattctgaaaagtgtgttactaacattgagaaccaattctttatctacttggacgtgtatcctggcaatataactcatcaaaatgaaatacacaattgtagtcaagaataaaaaacaactcaatttattgtagagatagtcgagatatcaattttatggtttatttattatatattcttcataaggtctgatgaaacgttgtgttagaactcctgatacatagtaatttttttttatggaattaaaaatacggatttgtcatccatctgagaaaaagcaataaagaatagagataatagcaagtattgaaatgataaacgttgaaaatattctggaatagtttttcctttgttatattcagaatatatttctgcaataaactcgaggacatcatatctggaatgtcttaaaatgaattgtcctcaatcgagatcccatgtagtgattattaggtctatacttttgtcaattagcatcgaaataattgctgatgctccttgtaaatgatttctcgcagtatttattaataacttgtgaaagaattgttgaaagccaaataaaaaattaaataaatttttgctaccataatatctgtttttattttcaagttgaagagagttgtgagaggaacatgacgggtctccttgttcagccagatgtgattctggatttcaattaccaatgtgtactctacggcaaattgtatttacacttataaatactctatcgaagtagtgtcctaacatacattcgttaatcttaaaataattagactgtctgcatgtaaaaatgaagaataacttagatagaatacatttaaatagtatatgtacatacaaattatgttgcctaaaatttgttaaaatagaatacagggactagagaacgtttaacttaccaagctatctgtagaacataataaattaacacaaaaaattattcattacatctattgtaaatgcatcggacttaaagtttaaaagaatacttactcactaaaaaaaggaatcacaatcattgtaaaataattaataattattataattagaaaatagcaattgccatgcagacactctaaccaccaaaagtagatgaggtaaaatttgaattcatacactatttaaatatattaaatttataacaacttgagcgtagcttaaaattagtcaacatttctgtctgtctgttgaatatagaaagaagagatactttcttggtttaggaaaaaattaatatcaagttaaaatttttcaacactacataaaaccaaagaattgattgtgatttaatggaatttgcaatcatatttaacctaaacctgctcaaaaatgaaaggcaggtgggtggtcctaatttgcataataatagctctcaattaattgaaatctattatagcttcaaaattggtggttagtaatttttgataattatttcttttttgttacaattttgggatttttagaggatccatttcacacaattgaatgaattcaagagcaatgtgatttcatctcagtgaagaattctaaatccaaagacggggttacttttattagtgaattttgcaaaaaaaattatgtcttggaaatattgtaacactaacttcatgaattgtcaacttcatgtctaaatatatacagtgagtgaattactgcagtactctcatgtcaagcaatttcaattcattaaaacaaatatgcactggagctcttttataaaaaattaccatatgcaataaactttcaatatttcattattcaacttgaaaagggactcaatgaatttaggttagttaatacaataatagcaagaaactttacataattttttgaacaaatttcgtttttctaatttttcaaaaattttaattagaaaattattccagatataaataaaaattatctgatgaacagtaacctggatgccaattcaaaaaaaaacgtctttagggccgcaaaaaattgtactcagtgttgggaaaaatagaatttcaatctggatatagcatagtaccatatttgagaattagtttgatttatttcagttgatgagttaggcttttcaatgtgcacaatgggccaagagacacaggagtccccaagaatttatctcaactgaaaatatttttttaagtacacaaaaaattgtctgtttgtccagatgtggatgcaacactactagggtatgctttgctaaaatgttatggaagttaataagaaagttaaattatattattatttttatgcatatgaggaaaaatacgaattttcaattctgaagaagttttcgaaatatttatcagaattttgttcggcttgttacacctactgctttcatctacaattatcaatattatataataaatataattgtcatattgtgatacaggagagatctggatttaggataatttcttactaaatgcttagtcattttttcacctgtttgaaaaagtctaaactgacattattgtttccctattccaaatttgaattaggtagaatcaagttaagcgataataaaacaatattatgtccgtggaagcagttgcggacatcaattacaaaggtcaggttagctaacagactgaggatgttggtgagtcatttgtctgtctaatcagagtaattgattttggcgggagtgaccaatccggctgctctcttcacgtttatcaagccaacacgtttccaactgttataacacatacccatattatttaaattgttgacatgcttcaatgtgattcctgtggatccttcagttacccaattaggctcattgatttttttctcaaatacatgtggattaggagtgatatcagatggaaaaaaagttttgattgaattaaaataaacacggatatttttaggagcacagctggtcaataggatttgaacaggagtcacattgctagaataaagatgatcgaaaggttgtcaagaactgggccactctttaaaatcattaaaatgtttagcacctgcattgggtggttgtgacgaatatcctccaacttgtgatccagcatcgctaccatatgaccttggaggagctccatagccatcagctgaatatgatccataactggcatagttgtagtctgatcccggtttggagtttgttgcagagtttgacatatttggaggtgcgctgggagtggcaggaccaccgggaccagattggcccctagagtacatatcccctgcaatatacccggatggtgcagttgatccactattttgtggcatgttccaactattccaacttgctgctccactgcctgcattaggaccatatgacccataaccctgttgctgaggtggtccaccgtaattgtttccccattgtggtggaggtccttgaggtgctggtggtgcaccccaaccttgatatgatcctggccctgaaggagtaccgtatccagcatagctctgctgttgtggagatgtaccccaaccttgataactctgcatcatattgggacccataggagcaccaatgctcattggtggcccgcccatctggccatttggaccttgtatcattcccataggagcttgagggggtccccaagctgatgatggatcccctcccattttagttccacctgaaccatctcgtggttcagctttttttatttcaacttgttttccatttaaattaacaaaatgttccgatacacatcggtcaacagcttcatcatcttcgaatgataagaatccaaatcccctcgattttttcttttcttggtcatacattatgacaacttccataacctttccaaaccgtgtaaagaaacttctgaggtcagtctccgtcacattcgatggcaaaccacccaaaaacactttgggatatcctccaccctttttcggtttttgcaaagtccgtggattgcatggtttaggatcaattgttcttccatcaagagtgtgaggtccattctgcaaaacatgggttacatttgcaggatcagaaaatgtaacaaacccaaaacctctggaccttcctgattcggcatttttcataacaacgcagtcaattacttctccataccttgaaaaatatctctgtaagttatcctgggttgtctcccaggatagtcctccgacaaagagcttgcccttttcgtcatcgtccataatttcaggttttaatcgcaacattcgcatgctattcccaaaacaccagtaacacaacactttccttatactaggacccggttacgttcaccattcaccacgtccaagcttcaccacaccacactacactacaaatggcagctagtgaacttccgtcaattttgtgtaaaattaattttaagcgccaccgctataggaccttcgttttttattcgaatagaaaagaaaaaagtgcata

SEQ ID NO: 30 - DNA, 825 bp, Leptinotarsa decemlineata
  Annotation=Peptidyl-prolyl cis-trans isomerase 5; Tribolium gene name from OrthoDB database=TC014505; Blast E-value Tribolium Gene vs. Leptinotarsa Unigene=1E-114
gaagaaaagcgacaacagctgtagaaagaatgatattttaatttcttatttcttcatggtcatctcacattcattcgtatttcgtttctttaagaagttgggttacggaggaataatgaaaaccctattagtaactttagcctttgtaggcatattggtgtttgttaaaagtgacgatgctgcaaagaaaggaccaaaagtaaccgataaggtttggtttgacatcaagattggtgacgaagaaatcggccgagttgttattggattatttggaaaaactgttccaaaaactgtcaaaaatttcaaagaattggccgaaaaacctgtaggagaaggatataaaggcagcaaatttcaccgagtgataaaagatttcatgatccaaggtggagacttcacaaaaggagatggcactggaggtcgtagtatttacggagatcgtttcgcagatgagaatttcaaactgaaacattatggggctgggtggctgtcaatggctaatgctggcaaagacactaatggttctcaatttttcataactaccaaacagacatcctggctagatggccgtcatgtagtttttggtaaagtcctttccggaatggatgttataaggaaaattgaaaatactaaaactgatagtcgtgacaaaccagagcaagatgtagttattgccgattctggctctgaaactgttgatgaaccattcggtgttgcaaagcaagatgctacagagtagattacttaaatgtagaaccttttatcagtaggtaattactttgtaaattgttttttacctctcatgcaattaaaaattacttttta

SEQ ID NO: 31 - DNA, 674 bp, Leptinotarsa decemlineata
  Annotation=Peptidyl-prolyl cis-trans isomerase 5; Tribolium gene name from OrthoDB database=TC014505; Blast E-value Tribolium Gene vs. Leptinotarsa Unigene=2E-113
atattggtgtttgttaaaagtgacgatgctgcaaagaaaggaccaaaagtaaccgataaggtttggtttgacatcaagattggtgacgaagaaatcggccgagttgttattggattatttggaaaaactgttccaaaaactgtcaaaaatttcaaagaattggccgaaaaacctgtaggagaaggatataaaggcagcaaatttcaccgagtgataaaagatttcatgatccaaggtggtgatttcacaaaaggcgatggcactggaggtcgtagtatttatggaaataaattcgcagatgagaatttcaaattgaaacattatggggctgggtggctgtcaatggctaatgctggcaaagacactaatggttctcaatttttcataactaccaaacagacatcctggctagatggccgtcatgtagtttttggtaaagtcctttccggaatggatgttataaggaaaattgaaaatactaaaactgatagtcgtgacaaaccagagcaagatgtagttattgccgattctggctctgaaactgttgatgaaccattcggtgttgcaaagcaagatgctacagagtagattacttaaatgtagaaccttttatcagtaggtaattactttgtaaattgttttttacctctcatgcaattaaaaattacttttta

SEQ ID NO: 32 - DNA, 3982 bp, Leptinotarsa decemlineata
  Annotation=Methylthioribose-1-phosphate isomerase; Tribolium gene name from OrthoDB database=TC002054; Blast E-value Tribolium Gene vs. Leptinotarsa Unigene=0
agaaaactttttatggtatatataggtttacagatgaattcatcaaaggcatcacatccccaaacttaaaactaaatgaaaaatttttgaaccaactttgaaaaatatccgtggtggaattgaaaccgttccacctctcccacaaatatatttattgtgaaataatctactcttctttcaaaaaaaaaacctttaaagaagggagagattttgaaaaattgaaagaacgtactaagtggctttgataaatgatcaatataaagacattctggaagatagaaaaagacaaaactagtttcagcatcaaataaattgtgtcaaagcttttctctttctctctcctgaaatatactctctgactattcttggaaactgtattcaaaaattgtcacgtcggtccttcgagccggatctgaaacagtaatgccggttcagatccggctcgaaggaccaatgttattcgatacctctaaaaaaaatgtaagattttttcagtcgcaaacctagaaaattgctttgacagagttttaaccggccgagaaagtttacattaattcaatgaattgtacaccaatcgcttggaggaaaggaaaatcaaacgagcggagttctccaaggatctctcttggatccagtttcgttttacactgatgacgtcacaagtctctattcggaaatatctgatgagctgaaagcagaactttcgaattttcagtccaacattctagaattccttggttcaaaaattcctcaaggaagatggcacataaatatcgcaatttcgacaacagattcgtaacaaaaaaacttgtcggcaatgttgcgtcattcgagaaattctcggaaaatataaacggcaaatgggcttaacaggtatgctacagtaaatgctaagactgaagaaaattgtaaaaaccttccaaaaatatatatgagcagagattatacgcagttataggtataaaagcaaggctaccacccgcgctagaattgccgcatcgataaaacaaaatagcttcctcaaaatatctacggcgagtcattaagtagtaagtacatgttcgttagtaacgaatttcattcaaagtccgaccttgaggggagagattattcacctccgccctgtatatattcagaaaactgcaaaacgttaagcatgctaggctcttgaatgtcaaattggaaagcagatgagattctaaaaattcaatagtatacggggttctttatgtatatatcaaaaaatctgataatatatctcaataattgacaattcaaactgacaataattgacaattccaactatcttataaaacactttgaactgtcaattaaataaatctcattcgaaataaacaataattaacaattcaatctatcttatcacacactttgaactgtaaattaagtgaatcggatttgaaattaaaacaataattgacaattcaaaattacaacaatgaaactgacaagaattgacaattcaatctatcttatgagacactttgagctgtcaattaaatgaatctgatttgaaattaaaacaataattgacaattcaaaatgacaatcaaactgacaagaattgacaattcaatctatcttataagattgtcaattgaatgaatctgatttgaaatggaaacaataattgataatttccactatcttataaaacactttgagctgtcaattaaataaacctgattcgaaattgataaaattatagacaattcaaactaacaatgattgacaattccaagtatcttataaaacaattttaactgtcaattaaataaatctcattcgaaattgaagcgataattaacaattcaaaatgacaataatcaaactgacaagaattgacaattcaatctatcttataagacactttaaactgtcaattaaatacatctgatttgaaattgaaacaataattgacaattcccactgccttataaaacactatgaactgtcaattaaataaatcccattcgaaattgaaacaataatcaacaattcaaaatgacgacaagaattgacaattcaatctatcttataagacactttgagctgtcatttaaataaatttgattcgaaattgaaaaaaattagacaattcaaactatattataagaaactttgaaccgtcaattgaataaatctaatttgaaatcgaaacaataattgacaattcaaacagtgttatgagatacttttaactgtcaattatctttgatctacaattgaaactgtcgattataaaaagagaatctgtaactctttagctccttcatgtaactgacctgctaaaagcaaagtagtgaaatttcaagtcgaaatattgaaatctgagaattttaattcaaatctcgaactgttgagctaaaaagacgtgatttcaactctgtaattaaaaatctcaagttttgagttgaaattttcatttcatgagtggaaattttaattaaaagtcaaaatttggatattgtgtatactattgaattcaaagttggaagcttccgcagttttctctgtgctaattatgaatccattcgagcaaatcttaaagacaaacaacgatggtgaagcaaatatttcacgcgttcaatacataactcaaaatgtttgctgtcttacaatacaccctgtcgatccaataatttcaagtaggaactagataagtgttgactttcaacgagtggtttccttgcttaccgcctgcattgtttgatttcaacaacactagcttataaagtaaatctcactatgggcgttcatctcacaggccggtgatctgagcaaactgttgtttcaactgctcaggtcgaaaaattcctgtttccgttatgatgccggcaataagggcagccggtgttacgtcgaaggctgggttccagcaggcgatacctttggccgcaatcctgtgctccccgacatgggtcatttctctatccggacgttcctcgatgacgatatgatccccactggggactttcatatcaattgaagtgaacggtgctgctacgtaaaaaggcactccgtgatattttgcaagaacggcgatctgatatgtcccaatcttgttggcagtatctccgttagcagccaccctgtcggctccaaccacgacagcagtgatgttcctatgcttcattagggctgctaccatactatctacaatcagcgtagccggaattttatcgtgaacaagttcataagctgttagacgagctccttgattgtagggccttgtttcggtacaatagacgtgctccaatctcttcatgtcatataaagttcgaataacacccaaggcagtgccataattcgcagttgctaaagacccagtgttgcaatgggtaagtattctcactagactatcacctgaaacattcgataatatttccttggcaccgttatcaccaatggctttattatccgcaatgtctttcgccaacatgtcttctatagtttgtaggaactttgttttcatgtcatcaagactgacattgggatctttgctgagctcattagccagatcgatcaggtcttcggcagcaattttcatgttaacagctgtcggtctggacgaaaccaagtagttcagctttccttcgatttcctgacgcatctgtttcttgctctcgtacttttcgttgcggatttccacggccaaactgaggcagccaacgatggcgatcgccggggcccccctgacttgcatcttatttatgaccttccaaccatcttcgacgcccttcacctgtatgtacttggactgagcgggcaacagcaactgatccagtatttccaaggaattattttcgtatttgatagccctcaacgacatttttaacctcacttgagtttccacgttccgccgatatttcgtgaattccagcttattcagataaatcacatcttatcttaattgcacacttggttgttgttagccggtaaaggatgatcgctatttgaa

SEQ ID NO: 33 - DNA, 697 bp, Leptinotarsa decemlineata
  Annotation=PRKR-interacting protein 1-like protein; Tribolium gene name from OrthoDB database=TC005495; Blast E-value Tribolium Gene vs. Leptinotarsa Unigene=3E-32
tcagggaatgtcactcttctatacaaaaatgtattattcttagtgtgcacaaaagttttttcttggtgacaattagaaaccatggaaattttcccctttcatcttgaaccgaaaactagtgtaggaaaccaattcaatgaattcaattattttctgaagattgtctttcattttcattcgtattattagacaactttttgctttgttcggaattcccttcttttgatatggttggactttcaataatttccatagcatcactaccgttttttatgtcagactcatttgtaatgtcttttggagcgttttgatcttttttttctgaagtactttcttcaatacattcttcgtcagaagattgtttatcatcatcatcttccgaagatggcgatgattcactttttgagattgtgtcagtgtttggttttttctgttttcctttctgtttctgttttttcttcaatcgtttcatacgcttttttgcggtccgctcttcagccttccttttattatcctccaacttctcatgatactcctcttctaatctatccttttcagctttctccttcatatatttctgtcttgcatattctttccttctaagatgccgataaacatggaattcgccagaaccagcacctgcactagatcccattacatttcttacaaaatctggcacattcggaacccctttttc

SEQ ID NO: 34 - DNA, 2827 bp, Leptinotarsa decemlineata
  Annotation=Serine/threonine-protein phosphatase dullard-like protein; Tribolium gene name from OrthoDB database=TC011922; Blast E-value Tribolium Gene vs. Leptinotarsa Unigene=6E-146
aacgaaataaaatttattcgtattatctacaaacaatttcaactacaaaagttcaagcatgagacattatcgcactattctctccccaaaaatagcactagttgcagaaggggtgggctcgtgaaccaatttgcttattaatcagttgaaatgatctgttaactgttagtcaatactattttatattccacactggtcagaaagcacgactgttcagtttccaaggagtttttttaattcatctctgtgcgtaatcacataatgggaaaagagctgctcattatagcgccatttcatagaagctaggactatcaaataaaagaagtagaaaaataagtataaaagaaaaaaaaaagaatagaaggaaagaagaaaaagaaaagaaaaagaagaggaaaagaaatgaaaaaaggaagaagaaaatagaagaaaaaagaataagaaaaagaagaatataagaagaggaaatctgttatgttctgtgatttagatatcgacaaaaatatcctggacttgttactggcagtaaaatttaatttggtttgagtttttgcatagtttgagatgttttgcaagctccctagactctttttctgttatttcagttgggtattagagatcagtccaacttgaaaaagtaagtcctcacgtggattttcatcaggtatggccaattccactcaaatttttatgacatttgacaagcacatttattaaggaatataaattattcacccctttcgtttcatttacatgatgaatttagaatattcaccatatacgtggatgtgagctagaagtttcctttgtttcatttattaatagtctcaaaacaaaattctgtacctgagaggtaaactgtcgtaactacaaaattctcgaatatctaccgaaatttcctgattttagataccacaacgaataatggatcctttaagagacattttttgttggggagtcaatgtctcttgtttttttggtttataactttccctgagctaaaaaataaaacaaagctcatcccgaaaagttactgcgtaacataaaccattgaagagtccaattagtcagaatcttgtccgattctctattgatttagctgtttaaatctcagataatggaagttataaattccaaaaacattgagaaatattagtcatacaattcaaagtagaaaatgattttgtgaataagtcactcggagatgtttgaagatctgactaaacattaataataatagtagaattacactattgcaaaacatttcaaacatacttaaatatgtgaagatccattgaagaccgaatttgctttgtatgcatgaagtctatgcatttttcattttcttgtcttgtctcttagaccagtgctatccacgagcaatttgcattaaccaaaagttgtgaacttgagcaattcaaccgactaccaaaatggggttgcaaacctccaccccaaacaacttatccagcattaaaagtaccagcagctacttcaccccctccgggacttacccttccaaagaattacagacagataaaagacaataccaatcttccgtaatatctaattgatcaaatacaacgactacttacatcttaattcttacactttagaaaagattcaagcgatagtcaataatctgtctcgtgcgaccgtttcgtctctattcaataacaggtatcgtatcagttaatgcacgttctttggggtatgcgtgacttgaattttttactagcgccctctttgaggggcgaacactcgaactcttgtacttgcgagacgatattgtcgaggcagttgtcgctctgctcgagcactttcgaaggattaccgtttgacggtaaatcgctcctgttacggctgaaacgacaaactgctctgtatagagttgagttagaaggggactcacctatctaccatcgcttctgcgcgtgcaggtttctcgacagaacggaccggacatccgctgtgaagcgaagcgcgtccagcaccggaagcaggttcaggagcgctatgtccgtcgggtcagagaaccatgacttgatggggatggcgttgtcaggatatgctctataggcaccaggactgttgtccaaaataaatatactggagagatcattacaaatggcactcagatctttagtatatcccagcacgtcgggggtacagtgctgccgatagtagcgcctctgaagaataccacggccggcgtctagcttatcagctacggccgctccgtaaatctccatgctagctgtgaaaacgaccagttcataccattgtgaaactatgtctaggaagaagtcgacgtgtggccttttgtgaacgaaaaatcgcacggggtgtctgtctatgatgactttgagtacaaaatctggtggcgttcccggtcttactgtctgtctcacaacaccgtcatgatgcgagtgtatcaaggtctcgtccaaatcgagcacaagcactttccgtttgactatacttagtctgtgccttgataaaggtgataaaggaaaaatatcgtatttaactgattgatgctgtattattgctcgactctgtttcttcaatgtgtagcataagcatgtccaaactctagatgctattagcaaaaatgcacgaagccccatctgtaactgcttccacatcgaaattggagtttcataaagcggttatcatacaataatagtaagtttgcaaattatacaaacaattttcacaactctgttgatatcattcactgttcacattttagctttatcccatctccattcgcaaaacgaccattaaaaatcgacctactcaatttgacggatgacatttactc

SEQ ID NO: 35 - DNA, 5471 bp, Leptinotarsa decemlineata
  Annotation=Protein FAM13A1, putative; Tribolium gene name from OrthoDB database=TC013074; Blast E-value Tribolium Gene vs. Leptinotarsa Unigene=6E-140
gtgttgatcgcttgtgttgaacccgatgtagtgaaaaaattctcacctacgctctattttcgctatagagcattatcctgtacttggtgccaagtataaatacgagacgaggttcgaactagtcagcgtccgaaaccgaatagtgtgtggcgggccggactcaggcacatgctgaaatttcgactggtttcaacgcactttttgaaacagccatagattgccatgtgtcgtgatagagatatgaacccgctgtgtttgacatcgtccatcatctactaagaacaactcgttcatttttgtcgtagctagtaaaagtttctttatcgcgagtaaccgcggccgacaccgatctagttttaaaaaatcttccagaggctgcccatcagatactacgattcagcacgaagaatgaaaggacctacaaggaaagatgatgcttcgccgaaaacgtgcaaggcgaagagactcgccaacaccgtaaaagcgccgacaatccccaccacgttcgacgaagcgaaggcggccatcaaagcgagaaagcgaaaagagagacaagagagcatcagctcgctgtaccaggagcggaaagtgatcaggtccaactcggaagagcgacccactcagaagaaacacgtcgagatagtggacagcatcaggagagtgtctagcagcgaggacttccagagtcagaggtcgacgtcttcggaaagaaatgcgtcgccgtacaggggcggaaccagcgacaagattttgttgtacgaggactgcgaacatgagaagagaaggtcccacgaaagattcgctagacccttaaccctcaagagccgaaagcacccgaacaaacgcttaaaggtcaaatatttcccgaggacgaaatacaagcccgaaccaccaatcgaaaacagagagcctaagaaagcgacgccgcctgtgatctccaaaaccaccgattacgaaccaccttcggatttcctccagatccacggccacgacagaggccgatcgcccagccctactgaagaactcgtatctccggtggtcgattggtccaccatccacgaactggttgatggttcggagcctgttctggcgcaaacttccaggcagatcagcgaaaatacggaaaccatgcccgggctatcggtggccttgaaccgtcttctatcatctcctaggaactcgatcatagcgacccacaaaatatacctcgacccggacgttcccaaaacgacctccgatttggataagaagccgcaaaaccctgtggacgaaagattgcacaaaaccgcgaagaagatcaacagcttgaagaagaagataaagaaatgtgaggcggactttgaagtaaagcacggatacttaccctcgcacacagataagctgaacgataagaatttgaagaagctctatgccgacatcaacaaactcaagaaggagcagaagcacttggcggaaatttcctccagctgttctttgctgatgaacgcgggagagaagtcggaacagctgagcctggttagcctgcagatcaccataagcgagatagaaaagaaactgactgcaaagagggaagcagcgaataggagcttcaacatagaggaaatgtctgcagaacaactgatggaggagaagatagccgtacagaaagcattacttttcttagagtctatccacggtagaccaaactccagggaggatcgcgacattgtcagacctttttacgataggtacaggacattgaaacgaaaaatatctgcgaacaacccctctggggccgagttggccaccatccacgagaacgaaacgatgaacttcgtaacaccaacttcttcgtcccaatcaaacgacaccgaatctgagaaaacgacggtaccgccatctatgagcaccgacagcagcgactcggacagttctgtgggcgaaaacctccactcgctctccaaatccgaaatgatagaacagctcaaactagcgatggaagagaaaaagcggttgaagcgaaaaataaaagaatttgaaatgaatatccagctcaaaacgggaaagatgattcagaaggaggaaagagctccgatggagagtatatacgcggcttataagaatgcgaaagcgaaagcgagactgcttgaagctttggttggaaaacagggtagcgtctaaagctaactataaatacaggtggttaaacatgagattgattttagaattatttttcagactgggtatagtgtcacaaactcacaacaaacttgtaacaagcgaaagtttattgatgaaataattttcatgccttcagttattcacagcaatcataactgccaatagacctttacaattccctaaaaaaaatttatgaagttgatgttattcttcagttctgaaagaaaattgttcattcttcaggaggcaacaccaaaattttccatttcggaggaaattcgaagtttcaagaatgcatgtgacgtcactaccattgagacttgcccgctctttcaaaccgcgttccaatgtactacttaatgaaatagctcttcaacaaaattttaaatataaagacttcattttgtgatataaaacgcttctcaatttcgaaaatgatcatcaaatcgaccttaataacaagttggcaacgtcgcacgcacaagaatacagaaagaagaagaaaattacgttatacaaaatgaataagttgccgaaggtgttgccaagtctatatcaaatgtgtctatgtgtctaaaaattacgtcgagaccgtaatttttactcgctattgataaaaactggtgacaaaaaattgtaaacggtatgaaacgaggcaatatcatgcatatagttttcacctatgcagttatcccggttagtgaaaaagtgcattagaatttgaataattcaaatgaatttcaacctctgacagactaggaggatatctcagtgtatgtggtcacaaaaatttttcaaatagaaactaataatcttttggaactgaataactaatttcagcgcctttatcgcacaactaccggactattgaaatagcacgatttttgcaaaggaattcaataagctccgtcacgctggaacccgctttgaaaaaatctgcctttttttagtctacttcacctgcaaacgataggtactgatgaatgtagtaatgttcattttttgtagtctatcggttactgagaaagcactatcgatattattcaaactacgaaatacaagtaatggtgcgctaaaaagttttgaaataggttctgaattgattgtagtttattgaagtaacaacacaatatcaatttattttatgttctttcgaagtatagcaaaagggactacgatggcaggacttcaagtcatggaataacagttgtcctcagactgcaaaatatggagttgactgtacctgaaattagatgtttagtttccattaaaataaagcattctaaaatacgttagtttttacttcagatttcaggttacttgttggttaggttaggttagtttagttgaaaatactcgattttatttcattcatttttgatgtgtttaatggtaactacaaacatctaatttcagctacaatcaaccccatcgtttgtagtttgaggacaattgttattttatgatttgaagtcttgttatcgtagcttttttgctatacttcgaaagaatataaaatatagtaaaatatatataataatatataaactacaatccatttaaaacctgtttcagaactttttggcacaagtattgctcgtcattcgtagttggaataatatcaatagtgctttctcactaacccatgagactacaaaaaaatgaacattactacatttattagtatcgtttgtaggtgaagtaggctaaaaaaagatagatttttttcttatttttcttattctcattccttcatgtgttgtcttttttatttttcttctattgctcttttaggtctaacaggatatatgattttcgagttaaatttgatgaaaagagaataaaatcttcaagatttttctgaagattttacagattcttacaacagtttcaatgcttacgatttattgttgtcggacgatgcgaaaaattccatcattggttttttcttagagtttaatggtttttcatcatcgtctgaagaaagttgaacggattttgagcccttctagatatcttgattcgaaaaaaaatcaaagggtttcaaatctggtaattcggcggtcaaaaggaaagggtccactgtttcgaataatttgccgtaatgaatagcattcaatgaatgtgatttttgattttacgtgaattccacttcattgctctgtagcttcccttcgaaactatattccttcgctagtaaattaaaataattgttgcgtactaaaaccgagattcaaaaaacaagtcattcattctcagctttgggaaaaatgtgcacaaatcatttaagacaataattcgcatgtaaaaatgtaataataatactattctataagtacctttgtcttgcgattgtaactggagacaataatatctaaagcgcattatatatttcatgacatctattagtgtttgtgaactttaaatttaaaatgttaaggtgttgttagtcaaactgttcaagaatcatggaaattttttctacaatttctgcgatatcatgaatattctcgttgaaattaaaagggttatatttttagtagagattattttttaggaaagaagagcttctgtataattcacacccaaaatcctttctttccgaaaagaatacctattcttattttacaaaataaagggaaaatgagaaaaaaagtgtgatatcaattcaagttgaagttagttcaaaaagtgacagtagatgtcaacgtagtacgttagattcacgagtcaaatgttgtaggttcgaacccaacttcgatcagaatttttctcgcgaaaaatttcttcagttgtagttaggttgattttgctgtgttatatggctgatcaaactgcgaattgccatggcgcttttaggtggctcgaggagttattaacataacctactcagaacacacagaagtgtacgtgatataaaaatataattttccaatctgcaccactgagattacaatttttcaagtgaaatactattaattcagtatcatttcacttcgtttgtagaaaataatattttcagaacataattaagagtaataacagttaaggttgaaatgtggacaatgtgcaatagttggtatgccgctcgattgtagattttacttttaacagaatacatagttatatgtatacttaattttgttacagaaattgtttttaaccacaccttgtatttttgttatgtactgaatggttattgttcgttacctagaaaaagtttccatgttatgaaagataaattatattgtcatatttttattatataattctgaaaatctcatatcaatgcttttgaatgttgttttagc

SEQ ID NO: 36 - DNA, 3673 bp, Leptinotarsa decemlineata
  Annotation=Putative deoxyribonuclease TATDN1; Tribolium gene name from OrthoDB database=TC009435; Blast E-value Tribolium Gene vs. Leptinotarsa Unigene=3E-171
gatgcttgctttgacgtatacagctgttagcagttgtgtttggatttcttgattctttgcgttatttttttagggataacgaaaatatgtcaggccaatgggaagttgttagtaagaagaaagacagaagtagcaaattaccggttcctaaagcagggaaaactgcgaatccagtgaatgggttgaaacaagacgatgttgcactgaaatcacaagccccaggagcactgggaaacagtaacgaaataaaaagaatcagtccgttaataaatctaaggaagtgaagaaaaggaaagaaagaccacaggacaaacctaagcccccaaagtctattgaaagtgcccttaattctattgatgcagaatactttcagtccatcttcgataagaccaaaaaccagtttcctgatgcccccattgtgtggttgaaagaattggtgtattttttgaatcaaaaattatcgctcgacgttcaggatgttttatttctttcgaaaccacagggttatccactcagtattgtgccttccgagataaaagccgtcattgaaaaagcattgaaagaagccggtagaagcaatacgcaactcttttttgatatatgtctgtcttctatggccaccgatatggccaaagggctgcccgctctaggatataagctgtttttgcagcaaatcgcattgagcgaaccaaagttggttactgagaatttgagtaaacacgttgttttgagggtgtcctaccagaacagactgaatattggtttgtctattctttggtgtgtggggcacgtcggatacagtgatttcaacagcggattatcggttttcaaagatctcttcctgccactcatcgaaatgaagagctactcccgcttcgtcttgacctacctcctcgacctcgtcaccaacaataaagacgtaaccgtgacaaaagaagacttcctcctgctcgtcgatacaatctattcgaccaaaaagactcttcccgtggatcttcttcagaaactatcgggcgaggttccgaaactgaaacgtttcctcttcagcaatactaaagaaaagtacaacaactacgtcgaggtggtcctcaaaaggatagtcgccaacagtagtgagccgtacaggaactgtctgtgcgatttgttgatcgatatcttccaaaaggatcagacgacgctagctagctgggggaaggtttacggcaaaactgtggtggccagcgcggttcttctggaatacatatttaatgattgggacactgtttcgaagaaattgaacaggaacgctctcaagagcgttttggacagtttcaagtcagcgaacgatgatctcaacctgaaaaaacggaaagaagacggactcaaagccagcattgttgctattcagaaaatcaacgacaagatgactgccaaaaagaagtccagtttcccactgaaaacggtaatactgataatttctttggcgataggaggcctggtttacttcgatatcaaacaacacggcacttggaaagacagcatgactcgcagtactctgaaggagtatcgtgtttgcgaatttgcgtgccttgccgtgaacaagacaaaagagggtttcggctgggtggacggtagatttgaagaggctttccccgagtaccaccacgtcgtgagatctgtctcagagcagtacattgagttgctcgtcaatcttgggaaactggcccgtaacggggccttaaacttgaaggatgctgttgtggaacagtaccccattgtgcttcagtcgattgaagcccaagttccgggtttaatagagcagtcgcagaacgctgtgagcaatgtttactcgtattctattcactacttcaatagaagtattgattttctcagaaaagaggtttttgtcggacaactttctcctgaaaacgttcagaaagtggtagtggatgccttgaatacaacccaacagaaagcggctgaatattatcactggatctatgaaaaagttcagacgagcatcagatgaatttagctgttgctcgatttttaaccgtttaattcctagactgatttattctcactttttaccattgcatttaattgttttcattagaatctatgaattttacggttattttcaacaagtaaaaggagctctggatgatagcccagtcaattttagtattgaatagtagtccggggatgttagcgttaccttcgaaccaactgaaacgtaatttttggttttgatgatacaatttgtagagaagcgaaatttttctggtttagttttgttggttcgcgacttcattgttggtaatcgaaaaaggagctccaaactgtaaggctgaatttctcgtatgaatacttgaaaaagtcgtctggtcagtagagttgattaaaaactactaaattttggtcttttcgcaagagtatttgaagatgttatcaaaacttctcgaacgtgggtacgtttttttaagcaagttgatcctttttttttgggtgttaactttgagtatttttgtgaagactataactttttatactttttttacgtttaattgaaataatacaatatcgaaatttcgttaaggtcagtttgtagggggtggtagtaattgacattgaacgtacgcagaaattggtatgatgatgattttattccactttttatatgttactttataagatcaaaacgtgtattttgaatttgttaatatattttgttattacgagagattacttttattgtcgaacaggaacaagtccaaagtgttttggtagatcttttcgcaaaactcgtcggcgcttacttgtttaactgtcgatacaatgtcgaaaacttgcctgatattattgggttcgttcctactcttgaccatatggtggggagaccatttttctttcttgacgctgggcacagcctggttttctttcgaaatgagtttgtagccagcgtgcgatggtcttacttcacaccaaggacagtccgtttccaaaagaattttatctgaaggtaaactttgtacggttttgaggttttcttcagtttttagggaacatccattcaaaccaatataaaatccgagatcgatgaacattttcgcttctttttcagtgccgtcaaaactgtgtacaacaccttttaaatttggatatctcgacaaaatagaatacaaatcatctgctgcatttctacaatgtagaaacagcggtagatcaaatttctcactcaacttcaactgcagttcaaaataccttttctgcacatccttgtcacaaaattgtactctatcgtaatctaaaccgcattcaccaacggcgacaactttactctttccctgcgatatgagatcgctgagtttctctaaataattattaggatcctgcccgttttgttcaaactctccacaccttgtaggatgacagccaacagtggcatacaatctatcgtcacttcgacaaatttcgagagcttttatgctctcctccagatttcctcctgttataacgattttgctcaagccagcgtcccaacttctttgtagaacttgctgtagatctggttcatgttttttggtgccattgtatatcccggaatacatcgcatcagtgaggtttgctccaatatctatgaattttcgcatcattttcattttttgagatattttgagttaactctaacctc

SEQ ID NO: 37 - DNA, 2709 bp, Leptinotarsa decemlineata
  Annotation=14-3-3 protein sigma, gamma, zeta, beta/alpha; Tribolium gene name from OrthoDB database=TC006109; Blast E- value Tribolium Gene vs. Leptinotarsa Unigene=1E-171
tatacaatatattgaaaaaatattggatactaattcaaaaaggaagattacaggatggttctgtgtgacaaaaaacttcattgtaggtatggtagttcaaagtaaaataatttatggcatctataaaaagggtatcaaagtatgcattctacctacctgtattttccataaaaaatgttcatagcatgacaggtggttgtgcaaaaaatgttattttttagttcttgctgaaagttcaggatttaccccatataacttaaataaatgtggtgttttattgtcagtctgtattggagaacagcactaaaaaatgtaagtatatgaccatcataaaaagaattatctcacaggaagatactctttaccctccacattctatggattagaaaaaaaaaagaaaatatattaattgaaagtattttttcctttgtgtaattcaatgtttatgtgaaagtaactgcttcaagagtgcttttattccagtttctttagaaaattcccacatttttttatgaggatggagaagtaggtagccaaaacctttctttcaaataaaaaaaaattcagtcacgttaaggctttgacacctattaaaaaatatttttcgcaagttccagaagacaaaataaattcagttaagttccctaggaaaaaggggaaagaaatagaatttcaaataattttataataatacatcaatttttttatatcaatctacacagcattgtttacatccatacgcacaataaaaatgcaaaaatacaatttaaaagaagactaactgcttaagttttgtcttgaaaaaaccagcaaattatttgaaacaatttcatctttattcatctttaaaatcctggcagtgcttctaagtacggctgactaagtacctggctgccagtttttataagacaataaaaattcattaaattatgtgatgtaacagcaaattttccaattaaaatcaattgatatgcatgtcaaagtaagcctaaaataattgccgaactttcaggtaacgaactttgaaaaaggatgtgtaattgagaattattgcttcaataacattcaacatgcaaaccaatttctaaatttaaataaatataataaaaatgcaaaacggaatgctaatttgtacggatatatgcgtgtttttcaaaaaatactgaatccataccgaaaaaataaaaacaaaatcacttgtatcaaatatacaaacgttctaactctacaagagtacgacaaggcaaaagatcgtctctaagcgtatttactaaaaaagaatcaacgacagaaatttccacatagatttaaatattggtcataggttggtaaaaatgaatcttgaaaataagcctctcataatttatacatcgtgccgctgcctcaattagtgcccaagacaaaacatccatctgataataaatcaaatgaaacttgtccggagaacaaatcagactggtaacaaatcattaaatactcgacaattttatttgaagataaaaatacaaaaaatccaacgttaaatacctaaagcgaagattctagtacaatcattcaatttgttccgaaaacaaaagcgactactatatttaatattgaattaaacatgtcacttatgttgacggacgaaaggggactcgcacaactcgcaatcgttcgggagagacaaaacagttacagaatatattgttacagctagtaataataatacattatgtaccagggctcaggggcaagtgattgcttgccccgaccctttcacaatgtctgggcaatgccctgcactacacagcactcaacagttcaatatcgccaggcgcaacattctgaaattatgatacgtcttgatcttctacatcttgtaattgttctttcggttccgcttcaccgtctccctgcatatcgctcgtccataatgtgagattgtccctgagcagctgcatgatcagcgtgctgtccttgtagctctcctcggacaaggtgtcgagctcggcgatggcgtcgtcgaaggctgctttagcgagccggcacgccctgtccgggctgttgaggatctcgtagtagaatacggagaagttgagcgccagaccgagtctgatggggtgggtgggcggcagctccgtcattgcgatatcgctggccgacttgtaggccaccagcgagtgctcggcggcgtcttttctgtcattgcctgtcgcaaactcggccaggtatcggtggtagtcgcccttcattttgtagtagaagactttggactctcccgaagaggcggcaggtattaggtgcttgtccagaacgcttaatatgtccgagcagatatctcttaattctttttcgacttgtgaacgatattgccgtatcatttcgagtttgtcgtcggttccttttgactcttctttttgttcgattgatgaaattatgcgccaggacgccctcctagcccctatgacgtttttataggccaccgaaaggagattcctctcctcgacggtcagttccaggtcgagtttcgccacctttttcatcgcctcgaccatctcatcgtatcgctcagcctgttcggctaattttgccttgtacacgttatcctccctttcagacatttttggatgactttcgatttaatttcacagcacttatcacacaaactctttaaactctctccgtattgccaatatggccgcgcccgccacactaatacccgaatct

SEQ ID NO: 38 - DNA, 876 bp, Leptinotarsa decemlineata
  Annotation=Ubiquitin associated and SH3 domain-containing protein B; Tribolium gene name from OrthoDB database=TC010119; Blast E-value Tribolium Gene vs. Leptinotarsa Unigene=8E-78
gggccgaaggatatttgaaggatacccctttgaccaatgtgggggtactgcaggcaaccctgctgggcgaatccttcagagagaaaaacatggacatccactacgcgtactgctctccagcgttgcgctccatcatgacctgcgacggttttctgaggggcctcaacaagaaggatcaaataaagatccgtgtggagcctggtctgtttgagtggaccgcctggtacaaggacgacgttcccggttggatgtcgatcgaggaactcaagaactgtggttacaacatcgatgaaacctacgtgccctgcgtctccgtcaaggatgtgcacgagtataaggaaggctgtgaccagttttacgcgaggaacgccctcatcaccagaagtgtcatcacagctcacaacacgggcaacatcctcctggtcggtcactcgaccactctggaaacctgttcccacgaacttctgggcagaaaaccgaagttgcccaatgacctgatcaagatcatccagaaaatcccgtactgcgccctagtacagctgaccggcaacggagacaagtgggaaatggccgaacccgtttgcctgccgatgatgcactccaacaatcagagattcgattggaagatgctgtttggagagtaatttttcaaagctattaggttagatttttaggtacaagaactgattttattaatgatggtacaaatgagacacgtgtattgttttttagccaaagtaggggcgattcatatgaagagacgtcggaattgttcctatatttttaatttgtgctttccagggagttttctcagctttcggttcctctgtttcgatactgacgcggaatgtttttgccgagtaagtgctgacgaca

SEQ ID NO: 39 - DNA, 4228 bp, Leptinotarsa decemlineata
  Annotation=Drongo; Tribolium gene name from OrthoDB database= TC014752; Blast E-value Tribolium Gene vs. Leptinotarsa Unigene= 6E-113
tcgtgtcaggtgtcagtattcagtcgtgcagcagtcactggttttcagtcggttagttaaaattacgtagttgagaaagtaggaattagaacatcgttcgcggacggaagttgagtgtaggtagttgaatcgtgaaaataatggcttcgtcacggaaaaaacaggacgagaagaacttgaagactttgcgtgaattaggtgcctttccccaaaacaaatactgtttcgattgtaaccaacgcgggcctacctatgtgaatgttaccattggatcctttgtgtgtacaaaatgttctggaatgctacgcggaatcacgccgccacaccgagtgaagtcgatatctatggccacattcaccaacgaagaaatagatttgctgcggaaccgaggcaaccaatactgccgtagggtgtggctgggcttgtacgagggcgcgtcgccgggcaccgacgaaacatcgatcaaagacttcatggtggaaaaatacgagaaacgtcgctattacctggacccggtccattcgaaagtgtcggaggtggcgtcgcagtcgccgttgactacggacactccgaaagcggcgaaagtcaacggggctcagatgcagtcggcgcacaggacgagaccggaagtgaacaggaataacgtcagtggcgggttcgcggttgatttcgatcgggctgatattttcggggctggcaagaccaccacgacgaacggcaaccaccaggagatcaacgcgccgcagcagaacggtttcgcgaacttcgacaataatcccgttttcgggaacagtgcgaatacggcgacgaatactgacttcagcatattcgacgtgaatttttccgaaactcagggtcctgtttttaacaaccgtcctctgtttccaaagtgcaacacaaatcgttggagtttcccaacacaagcgacattcaacaacataaacaactggtcaaacctgcagtcgaatcctccgcctttgaacggttcgctgaacggaaccctgaatggttctttgaacggtacgaagcctcaacctgccgaagacaaatacgctgccctcaaagatttagataacgaaataaagtcccagaagtcgggccagctggactggaactcgaccggctcgaatggttccctttacagttccccaacgccgacgggttctgtgtacagttccccatcgccgcagagttcgatatttggatcgcctagtcaaggtcagttcatgactgctttttccgcttcgcaagaaaacgggatcggaaacatttctaatcctttcaacagcggaggcgtgaactctgtcaactggggaaacgtcaacggcgtgcaaccgactccacagtcgttcgccaatccattccgggacccgatcaagtcgaacggatcttctcatcaggtcttccagcctataactgccttttccgtgaacacagtgcctcttgctgtgaatggtacaaacggatggaccgcgaatcctttcaaggttggcgggacatcaaccatgaattcgaacaacccgttcttatgaaaaacccgcgaccaccaagagcctatgccagtgtgccctacgattataagcaagttttagcccacatgttaactcattataacgaaccacataatatatgaatatattctctctctattcacctctctattttcaccaggcgaaagaaggaaatgttatctaccgggcaaatgtcaaactttctaatttatttttttgttatggtgtatttatttattggtccgcggccccgataagagtacagcgggaacttgtatcaaagttatgccaaaaatgctttcgtctattatattatatatacataaaactgttgtaggttaggttaggttaaggtatctctaggtagattttaaatacgcttatgcaagaaaaacagtaacgattgcctttcactatttgtagattttcggagagttacacgatcaaaagctcaggacaaatcgggttacagcttatgtgtgcacagggtggttcctctttctgctttggaagttgaaatattgtaaagactgaaattatgttgggaagttgcctgcaaattgtatcttgtggctgtaaaatattgatgtgttatacttcttacaaaactaattttgaattggagttcaaaatcacaaattgggtcttgcatacctttgaatcaaatcatcatcctaaatttgaaatagtcatctaatgaaatcaaattgacattccaacttttgaaattaccacttgaatcaacaattgccaactttaaagaagaaatgttctgtagaaatgacagctgtctcccaaagtgtcaacttacactgacagttatagattttatcacttggaagtagttattttattggtaattgcctgctcgaaatggtgggtgttgaattatatatcttcaacttaaaatataatgtatgcattacctcatccacagtatattcttttcctatttatgatattgtcaactgtcaaaattgatctctggaatgtttaaaatcaaaatatactcgtatgaaaatttcatttctacattcacatgatctttcatacatccaatgaatatcattgatcaatcgcaaaagctgtcaaatgacgtcactgatcaattcacaatgaaatctgatgaagtaatttttgtagaaaaatgatctgtaacagatattggcaagtgacaccatactgttattatccaaacaaaacacttagtcatagtaaaaatcaactgataagtccactcccacttctttcattcataaattcaccaagttctcagtgacctcgaaacgaagtgcggagccaatttcgttggtaaatcacttataaccaactacaaaagctaaaaacaataataacgacagcgaataaactaaacacaataatttccgaaccgtttattataactaatccgatgctcgtggtacgtcgaatcctttaatactacagcactgaacgcgatggatgagaatctcatcctaagagtggttgaaggtctttggcaacttgggtggatcacgtggtgagagagcctactgcttgtattattctactgtgactttgttgtatgtgatatgaaggaataattttccatattaagagcaccaggtttaaaaaacttagcagtcccagggtcatagccacttccatacagtgagaaacattgaattttagtggagcccaagtgaacagaaatgacgttgttgatgatgattattgattcaaagtagaaattataactcttatgaaatcagtatattcaacttttcaaacactcgaaattgttatttgtaatggcaacttccaaccgaataataattgtcaacaaaaaagttacattgacatggtggctatcacagtatatacttgttaacttcaactgagatttgggtcagtaaaattgtaacaacttgtaaatcttcaagatattcacttctcaattcaatcaaggatatgaatgtcgatttgaagtagactctgttaaccctaattaactattgggaatgtttgctccactgaaccatatcttcataacagtgaggttataaatgtcaatttgaagtatattttcctaacctcaattaacaattgtagaatccacttgcaattataatcacttcttgtaaaccttctcaaaatgtttgctcaatgtgacaatttacagctcaaaacatcaattgttaactggaggtaatggatgtcgactcttgacatttacaatgaatgtagtctcatgatgacaattattgtcgaacaacttgatgtagtatatatatgtagtttaggtatatctgtatgtagcccaaatcacttgatacaagatatgttcttcaagatagcatttaaaccactttatgattttttttgtgatatgagaaaaaggaactaccctatttttattttgaaacattattgagctctgatggcttctgagaaagttattattaaagttttgttgcaattttgagcatcaatcaattgacgacatattctgtgataaaaaattgctgacactaattgttcttatactaaacgatagatctaatacagtagcggagtattttatggtgttttttagaagaagaagattcgccatattggaacatgcgtgactatttttccgtcctggacactaacataggaatcttttttgcgagcacaatgtattctgtatattcatgaataatgtcgaaatggttgtgtaaataaaatttaacacc

SEQ ID NO: 40 - DNA, 3563 bp, Leptinotarsa decemlineata
  Annotation=NHL repeat containing 2; Tribolium gene name from OrthoDB database=TC004511; Blast E-value Tribolium Gene vs. Leptinotarsa Unigene=0
gactggactctcgataaatatgttgagaaaacgtttcaagtttagttggaattaattttaaatttagattcgtgatctggctttcattgagtgaactggtcgaaaaagtgtcagcgtcacaaattggaagagaggttgaatctgcaatcagagaagatcaaacagcacgagaagagataacggaccagtaaacatcaaatctaatcaagaaaacagaagtcttggattacagcatgattcacaatcagaccaagctgtaaccatccgaatcgagctggctaaatgcgcctatagggaagcaaaggccaagaactttgagtgaagtgaagtgaattttaaatttacagtgtaaacaaataatcttagttctcaaatatttttcattgataattttcaggtttccctaaacattccatgagtttattttcgaaaattattcgaaacattcgtaacagtttctccagaacgtccagtatgcaatcagttgaagattacttgtactactcccaagtaaaattacaaaactttattgaacaacgattggacaaagacttgggaatgcaagattacctaaaaaacgttaaatatgctcctgttgaagatttcaatccaggcttggagtggtttaatgtaactgaacccctgtctttcaaaaaacatcttaaaggaaaggtggtggtattaggacttcttcacttattgctgtatcaactgtatgcatattattcccgatctccgggaaatcgaaaaggagttttctgtggaagatggactagtagtggttggtgttcatagtgccaaatttgagaatgaaaaaatatcctccaacattttagctgccgtgcaacgttacaacatcaatcatccagttgttaatgatgcaaattcagaaatgtggaaaaactgtgatgtacaatgctggccaactttgctcatcttaggccccaattcaaatcctattgtaatgttcacgggtgaaggtcataaagatgatcttagagtttgtattcggaatgctctgaagttttataaggagaataatctaatatctaatcatcagttaccattaaaatcagcatatcactttctaccagaattgaaagggccacttttatttccgggaaaaattaccaacttcttggatgaaaataatcatgaactcttagcagtctcagatactggtaataatagaatactgatcttgaaagatgatggaagtatattacaacaaattggaggcaggaaacttgggtttagagatggaaatttagaggaagcagaattcaacaatccccaaggacttgtttttctgaataaagatattttatttgttgctgacacagaaaatcatgcgattagaagaatagatctgaagaaattgaaagttgacactgttgcgggaactggagtacaagggcaagaccttcatggcggtaaactctggaccagtcaagcaatatcttcaccatgggacttgtgcatctacagaacacctgatatggatttaactttccaccctgacggcaatccaccagttcgtaatgttctgatcattgccatggctggcactcatcagatttgggcgttatttcttgaagacacagtgtggtggaagtgcaaaaaatacccagctggcacttgcataaatattgcaggttctggaaaagaggaaaataggaataacagctatccccatgcagctggttttgcacagccttcaggtctagccatttgtcatacaactaaagaagtttacattgctgatagcgagagttccagtgttagaagacttcatttaattgacggaaaagtcaccccagttgtaggtggagctcgaaatcctaatgacctgtttgcttttggagacaaagatggtgctttattcgatgcgaaactccaacatgttcttgggctggccattagtcgaaatgagagaatacttttcgtagctgatacttacaaccacaaactgaagaaagttgatgtggctgaaaacatggtgacttctataaccataccttctgtagacatcaagggaggttcctcaactggattgcgggaaccagcaggactttgtgttagttacgataacaagaaattatacttagcggacacgaataaccactcgatcaaagtgttatatttagattctaaccaaaatgtgaataagattgagacgatgactctgcgtaaggcttgtgataaagtaacagctttggataaatcgaagtatgacataattatcagaaatcctctccaagtcagttgtgaaggtggaaagctgatagtgagcatggacctagtctttgaaaatgggctgggcctgacggaaggtgctccacaaacttggttggtggacctacctgatataacgtggtcagcggtaccattgaatggtacagacctaaagaatatagatttagttattagcgttccagtgagtgaacatgccaaagagaacaatgtagattttatattcaacttggttacatgcacgtctgagacttgtttgccaaaaagttttattgtaagactacctattcattatcagaatgaaaagaaaatgagtgtcaatgaaaaattaacagtggcaatcagtcctgataagatgaaaattttgtgatgggagcaatcgataatttttatttgataatttattttaaaatgtatagattatgttgagtactgtgaaagaaccgtcaaacttttctcaaagttttttgttaaaccaagtttaggtcatcaggagatgatctaaactaattttataatagagtttcaatcaactagtgtactttgttgttggagaacatatttcttattgacaaaacataggttgcacagaagaacccaaagttcaggtaaaaaataccttaccccttgtctttcatgtggacctacgacttcgtaggtatgtgtggcaaatacctgatggaaagacaacaactaacccagctgataccgcacagaaagctgaagtaaaaccatcaggcacctctgcaacgtcttccatttgtaagattcgttgaaagtgactgtctgcatatgaaaagcagaaattaatttcacttggtcggtttgaccaaccgatagactggtttccgggtacttgccccatcatcagtaccgggcgggtcccgatcaaacaaaattaattccagctagtcataaacgctttctgcaattgattcagtgggatgtccactgcgtcacctgcagacaaagccaggaaacaactccacaaatacatacgccggagtggaagtcaatggcatcaaactgttcaatcacctgccagttaaaataaaaaaaagctatgtttacaataaattcagaaaataggtcaaaatgcttctggttgatggggtctattactcagttcatgagtattttaatgatactttcaactcctgatacactcaagaactaatattttcttgctttgtatatgtatatttttatgtgttctattttatttatatattttaactcgtactgttctttgtatttttatactctgtctataagatttattttcttctgacaataaagtatatttgatt

SEQ ID NO: 41 - DNA, 1276 bp, Leptinotarsa decemlineata
  Annotation=Methyltransferase-like protein 6; Tribolium gene name from OrthoDB database=TC004823; Blast E-value Tribolium Gene vs. Leptinotarsa Unigene=6E-46
taaggtaatcatttattatatttcaatttaaaaaattgcttcctttggatttcagctccagtactacagggccgacgtcacgtccaagttcataacctagtcaggagttcctccaattttgttccttatacaacgaatttggcaaattcggatatgcagttgattacctcgttcacgggcagatcgggcgatggcaaacatgttatttgccgttcagttcgaggaatgatacactaaaagaattcgattttcaattatgggaaatctttgacttcatgttgatgatacactactttgcagtgacgagtggccaaacagcccgaaacaggtttgcaagtgtgttccaataatcaaaaatcgattctgacagttgtatcaccaacagcatatgcgagaataacttcagtgaagaatcctgcaccgacacctgtcagatataatccaacgcccttcatggtatttattagccaggggagtacttgttttctgataggtgtcaagtcaattaacctccagatttgtttctgcttcaaaccagtgtacaaaggtggtatctttggaaactcacttcaataaatttctaatgaaggaaatcatctatatcctccacaataattttcttttccatcagacttcttctcagtcatttgcagcactttcaggaacgttggcttctccaatgacctgatgatgaactgggaagatacgctgcgattgtaaaaacataatgaactggtaaaaattcaaaacctggcaagagtagttcaatgcttccagtctacggtttctacagtggtagttctaataatactttcaataggtcctttcaatttatgatgtatatccattgtccctcacttggaaaactataccattatatcaagccggttttgtggctttgcactgcacgaatattcttggaacatcaatattttcctttttgttcactgtcctcctatgaacatatgtatttcgtgaaatatgaaaaccagtctcttccaacaatttcgaaatgtggtctaaagagaaataataacttctggttccatcttgtcgcatgtaaaaattttcagcaattttatggccgggcttaaacctcaactgcgccatatcatataacccatagtcacgaagcaataaaatgccgccaggttttagtagctcatagacattttcaaaagtttttaaaacttatcggggtgtatggcagacagcacgaatattaacgtagctatatcaatggaagctttctggacttcgctgaaaacgccttcag

SEQ ID NO: 42 - DNA, 2344 bp, Leptinotarsa decemlineata
  Annotation=Ubiquitin-conjugating enzyme E2-17 kDa; Tribolium gene name from OrthoDB database=TC010856; Blast E-value Tribolium Gene vs. Leptinotarsa Unigene=2E-35
ctccggctcttactatttctaaagtactgttatcaatctgctcgctgctgtgtgatcccagtactttagaaatagtaagagccggagaccactgagaacgtaatatatcaagacaaatgctaccattactatttatgttcggatgataaattcttgtcgtgaatgccacttttggaggtttgaaaggatagtctgtcggaaaatgtattgttaagaaaaagtcgccacggaagtgatcagtcacctattctggaacattactacttttgagtgcattattgagaaaagacggagtggtttcaagcgttttagtttttcttgtgtttacttccatcagtttagttgccattcaagaagtttttatagcgaatgaacccgaaacaatatttatttgatttacgtcgtgtctgtgagttttgaaggaggccatctttgcaatctctatcagaggtcctttgctcgcgctttcattgtctggtgaaaagccagtatatatcacatacagactacatcaaatggctttaaaacgaattaataaggaattacaagacctcggcagagatcctccggcacaatgttcagcaggtcctgttggagatgacttatttcattggcaagcaacaataatgggaccaccagatagtccataccagggtggagtatttttcttaacaatacattttccgacagactatcctttcaaacctccaaaagtggcattcacgacaagaatttatcatccgaacataaatagtaatggtagcatttgtcttgatatattacgttctcagtggtctccggctcttactatttctaaagtactgttatcaatctgctcgctgctgtgtgatcccaatccagacgatccgttagttccagaaatcgctaggatatacaaaaccgatcgggaaaagtataacgagttggcgcgcgagtggactcgcaagtacgctatgtgatggcccggcccccaaaatccacatttcacagattagatgaaaaaaaaactttatttcattcaacacactggaggggaatagccagcctgtatttctcaaaacattaaaaaaaatcaacaacattcataaaaacatcaactgtacattttgctttttggacattgtggtagtttataatacgcaacacccgccgccacaatatcattcactggttttttatacgagacattctgatgatgagatttgtaactgtatgagaacctaactagttttgaatatttcgattgtacgtttaatatattgtggttgtaaggggcagcgttgctgggttgtgttttcttttcccccgagatcgcccggcctattcgaccacacacacaccaacgtgtccgcactcagactcttcattatcgttacttctcttgttagataaatttatatagtaggttttgtggtttcgctaagtgtaatgtaataaacattgtttcgacagcgttcaatctcaggtttgaatacgtttttagggatctcatcggaactaacaaagacagcaaagctgttacttaaacgtgggcttgagatcacgtctgcttgctcggaacgccctgctgccagtgaaaatccgccaaattgtgacgcggtttagctcgacatttattttcttccgatttgattactagctcgcgtgggtttttttaacccccctgtttaggtgttgctgaactttgaagtataatatttattttttcagaccgagttcgcggttccagggcggaattcgccattttctccgtcgtttccagataacaccggatatcctatggatgtaaggtgaatgtccgtaagacgtccctcaaaagacttggaatggatatcctgtggacatccgttatatatccaaaaaatatgcggtgtcttatggttggccaggttggtattctttggacgtccgttggatatccgcgtgttgtcgtgttgtgacagatttctgtcctggagccttgtgcgtaccgtctgaaaacttgtttcattttctcttgcaggtacgattgtaatattgaagttaacaacatgtaatagttttttatacataaaatataatgtgtaaaaaatccatcttgatgtagtggtttcacttcccacgtttctccaagggttgtcttttccctcctgatttttttaacgtaccgtacactttgataattctcttgattaaattattcagtgtaaaatatcaaacctattattacttgataaggaaacttaggatatttgttatatattttttctcgtcattaaacaggacataaaatacatttagagtgttttttctttactagcgtagtggcagagactctaaggactgtttagccgaaggagacgat

SEQ ID NO: 43 - DNA, 6292 bp, Leptinotarsa decemlineata
  Annotation=Tetratricopeptide repeat protein; Tribolium gene name from OrthoDB database=TC014056; Blast E-value Tribolium Gene vs. Leptinotarsa Unigene=0
gtattagttagccgccattttgaaagcgtttcagtttttaaatggaacgctataatattgagtatagttgttaataatattgtgaattcagacatttttgaatctatgatacaataaacaagttctttgaaataatttatgtctctgaacatatatgaactagtttatcaattatcgtattgaacactgacatgacgaatggcgaccattgtgtgaaggaaaagtgctgaaagtgagagcaaagtgtccaatatggaacccttgaattctcaactacttacaaaggcgctgaactttcatggtcagcagttgcaaaagttatgggaaggagaatttggagaaaatgaccttgtgcgaagaaacattaaggatttgaatttccatgtgtatggccaaagacaaaagaatttgtcatttcaagatagaggaaaaagattgaaacttcaacagttcctcataaaaaaggccaattctatttatagtttggaatctacagcgctaaaaaatgctgacaagcttgttactgaggatatgtatgccataatgcctcccttcgaaacttacagtagtgtcgacaagcaaaaacgtttacaattctttatgatgaatgtcaaagtaggagatttgattttgggaacaattgtaagcaagcagcagtccggcatgatgttgaaagtattgtgcactacaggaattggtgctaccatcctttatgctgctgatattaatgttaaggccttttgtcctgtggcaaatattatacctgcggtagataagaaaggggtaactcgtagttatatgatgaacgactatgtgtgctgtgaagttctggagattatagcggacactgataaggttgtgtgtggcatgaagggcgtttcaagaaaaccaagtgacccagaacatcgtcccccattgggactaatcactactgacgattttcccattgtatacaaaaaagcattggattacaagaatgagagttacgacagtgtgttagagaagagcgtcggtttcaataaccccaataacatacaatatctctctgaactgatgggcgtcaacaaatataataccttgatgaataatttaaggttcaaatttccggaaaatgagtatgccaaagaattgaggcaagtacaggccagcaaatgggcgtaccgcaacgtagccgatggtattgatcactttaaagctggaaaacacgttgaggctttccaatgccttaacaaagctctaactatagacccaaagaacgttgaaggtctcgtggcacgcggtgctctttacgccaacaatggaaactttcaaaaagccatagaggattttgaaactgctttgaaattgaacccgaatcatgccaatgctcgcaaatatatgggagagactctagtggcacttgggaggaattacgaggaagaaaacaaggtggaagaggccaggaaagcgtaccagagctgcctaagtatcataccttatcacgaagaggctcagaattcgttggagtttctcaaaaacaagacccaaccaaaggcattgattgagcctgctgaactattgttacccaccctaaatattcccaccacaaaagcccctgatgtcaacgatgccctcaaacagttgctaaaaacagaagacgaagaaaagaaagacaagaaaaagaagaagaaaagcaagaagcgtaagaaccgaaagcactccagttctagctccagctccagttcttctggcagtggagactcctcaagcagctcctccagtagcagcagtggtgattccagctcttcgtctggcgattcagacttcaagaaacgcaagaagcaccgttcgaggtcacacaagcgcaaagagcgagaaaactccttgagccccctaagcaagcgcatggcgatgatggatcaatcacacgacacgccaacgactaatttcaatttcaacaaaccggcagccacaagtaactttgagttcagctttgagcagcctgagcaaccaaaacctgtagaaaatgaatatgaagccaaattgagagctttcctttcagacaccaaaggcgattctgactatgaggaaaaagtaaggaaatttttagaggaaagtgccaaatggaagaagggcaaaggaggcgaggaaaagaaaaaaagaagaagaaggaaaagaaatccaagaaagacagcaagaagaagaagaaaaaggaaaagttgaagaggaagcagaattttgatctttccgagctggacgatcacaaaaagttgcgagatgccattaagaaagagctgagcaaagagaaaaaatctaaaaggcacagcataccatctgacgacgaagagtatttccttcaaaagtctggttacagtaaaacgtaaggatcgtagtgaaagtcccaagcgttccatgttggattctccgtcccctacaagggagcagaaagctcgtcaagcagtcgctgaggccgcagcgtcggccggaacacaaaaatggaaaatgcaaataggacccggaacgtctggaaattctagatttaaaaagaagcaaccagagaggcctgtcccatcttcagaatggggtgccgaacaagataaacacagtaaaaatggtgctaatatggatgattctccaccagtgacgaagaaatctgcacctgcttctctgcagccagcagagaaagctgttagcattagaaaagctatggcgatgaaagaaccaccgccgaaaaagcctgattctcccaagaaacccaaacctatggttccgccatccatgccaaaaattcctactggccaagtggttttggataagtttgggaactttagacttatgactccgccagaaattaaaaaatctttaggcgaacagccaccgtttccaccaggccggcgcccgccagagcctccagggcgtccgcggtccgacagccgcagcccgaagcgtggccgcagccgcagtcgcagcaagtacagccactcgcggtcatcaagcgggtcgaggtcgcgatcacgcagttaccgcagccggtcgcgcagctactacagccggtcgcgatcgcgatccgggtcgtactactcgcgcagccggtcgcggtcgcgcagctactccggcgaccgaaggcggtaccgcagcaggggcggcttccgcggccgatacaacgaccgggggacatactacaagccgcgcttccagacgccaaggcataacaaccagcgcggcaggggcggtggatattataataatagggattctaggtacaacgacagagactaccggggtggtaggggcaggccttatccgtaccagaaccgaggaggaaggaggcccagaggcaggtatgccagaggagggtaccgggactacagagacaggagatatgacagaagccgttcccgagatagagatcgcagccgatcgtacagcggaagcagagattcagatggttctccgcctaaacgggacaggtctgctgaaaaggagaagatcaacaagtactctgacggtgatgctcccgtcagacacgaggggcctctgtctgaaggcgaggacagggatgactacaccaccacagacactggtaagctgataaacagagacacttacgcgggaaagtgggctgagaagggagaagacaaagaaggtggcagttcctccgccaaagataacattccttctgaaacaaatatcgaggagatggacaagttcctgacaaagtgaagaaagataagaaagaagagatgatggaaaggaataaggatctgttgaaatcgaaagcctgatcctgagcagatgacggttaatattagagtttccaaaataatgtgtttcaatgttgatgaagaatatggacagcactttatttcaatttcataatttgttttatgttacatatgtttaataataataatgataataaaacattcaatactaggaagatatttaatgttttagtgaatcacaaatcaatagtccatcaattcagaattataaaggaggttggaggaatatatttcatataagaaaaacaaaataaagttctcatatgaaattgcttcctcaagtatttttaagctatttagcgaaatatatattgcggctttgtaaactatccagtggaaatctcacaaggtgttacttgaataataaatccaaataaaaatgataattggcgttgaatacatcttactttactacttgagatgaagaagaaattgatttcgagtgtacacgaaagagcttaattatgtgagccagatatttctttgttcctatacccactgatgtatagagttgatttttgatttgacaactgagcctactgaacagtatttttttcttaacagctgaagttggtacttattaacccaatccacaaataaacgtccctttgatgagaattgtataggaataagtttgttgttgttgctccagtatataacacatccagaataacaaagacacaactccagaaattgaatagtttcaggatatcccaattaaagtttattatataaaaagaataaaactttaacggggatttcctgaaaacagtactttatagtagtagtgccttttccattctggatgtgcaatataataaagtttttggctttctactactcttgatacaaaaaaaattatgagggaatcttccaaaggaaggaaggaagtaactctatacatggatgtgtagatcatgcaaagaagtaactgaagtaagacacaaactgaaagaaagtcctcctgaaacagctactttcatataaacattgaattacacgaaaaaaaagttaatataacataaaatataaactggacttttggcattttttatcaaatccaagttgcaatcacccaactaacaggcattcacaaaagcactgagacagctttgtatgatttgcaaaaaaatgtatcattcttttttgcattgtaaaatttagagtttgatcatccttttatttaagtacaaattttatttttgaggaaatttcatgactttcatcatttgttcagatatatagattgtgatatttattactgaagaacatttcacaccacaccctaatccccgaaactatttcttaaacaaaaagtattcaaatctgatctcaatatatttctttacaaatgtattagtacctacaaatacagcccgtattctgatttttattaccttacaaaaaaaatgcattgacagtaattttcatctcaagaagcttcataagcctttcaaaaccacgttctggatatatcaatctggtttgaactcgtgtaaaggtgtatcaatgttgtgtatctagcttgttaacgatcagttaaaaggtacttgaagaagctgtacatggacaatgtaaagatgaaatctttatgacaaatgacaaaatggaggagtggggtggtgtgaaatgggacgcgaaaaatgcttcttcgctgagggaagaatgtttgagtttattttataatgttacaatttagtttggtactttaattcagtgtactcacaccctatatatatatatacgatagaaaatctaaaaaaaaaagttgaatgaaaaagtaattttattgaaagagaaaaaaacggtctttcagcattccactgtgggaaagcagtgtttgagaagcatttaatgaaaaacatatcttcacttattcattgcaatgattttggacattagagtaccatctcttataactagcgtaagtcgtgtaagtatattcagaaatttgataaggtttaagtattttatgaattttctgtgaactgttcatactggcatatttggtgtagtccaaacatatcttgctcttggagtcactgcgagacgaaacttgtcgatggtatctaaaaggtatgccattgtcgcaatgtaacccaatacccctgtaactacgaatggtccaatcaactccgaaataaccaccgatgctgatatcaagtaggtacctgtcaaaataaatgcatttccacattcaatccaatgccatgggatttcgagacttctgaaccgtggtatcaggtgtgttatcagaaaaaatcctgttgaaaggaaagcaaaggcagctactaagatgaccaggaatgttttctgagcatttccgcaattgaaggctgcaattaacgctgacaaattcagcacttcttctgaaatgttcagaactccagaataactcttcagatattccgaaccgtgcttttgggtctgttgataaaagagttaattagtaaagtaggtaccaacaacgattttaactatccaacatacactcattttccattcaaactcatatctcacatttattc

SEQ ID NO: 44 - DNA, 3672 bp, Leptinotarsa decemlineata
  Annotation=p130CAS; Tribolium gene name from OrthoDB database= TC000029; Blast E-value Tribolium Gene vs. Leptinotarsa Unigene= 3E-149
actattcaaatacttttattttaaaatctgtaactcacaatgaattatatacaactaaaataataaataacaaattaaataatataaaaatgttcaaaaaataaaggacttattacaatgttccaatgcggtcaaataaaaaaagtaaaataattcatttgactatttttttttattgaatgaatcatcaccggtttttcgtttgtgcaatgacaatgttgattttagcaattatagttataacaggatagcaaagttgtaaaattataatatcttgaacaatgttctcactatataacaaaaatcactctattaccgaaatctcagaccaccacggattttatttataataattttagttgaatcatatatccactatttaaaaatgacgggtttctttcaattcagttgaatttaaatcatttgctgacttttccgctaactaaatttttaaatcaaaatcatagccatttatgagaatcagaaggattaaataaatacataatttgattatttaatttgaatactgcaaattattcagaaagttattattcataatataatcaataaattgaaagtaaacaacaacaaacatcccataataagtgagaaataaaatctatataaaagcataaatctcaaaattcaactgaaattgtagtaaatgtttttacaaatgatttccaattcattatgttcataagtaataattgaatatttcagaatagcacaaattgcattgttataatttttttttgatattattcaatttaatgcaattgaatacaataaaaaagaaaatcagttcaaataaccaaaaaatttacaatttaaaattgatccctagaatttttgagaattgcttgcaattattgaatagtataaatcatgtttctaagtaatttttaagtgtatttcaattacataagaatttactaaaccaacaaatatattttccatttgaaaataagctagttggaaatattgaaactttcaaactgatcttttaaatggctctacctctttcatagttaactttctacaatatacagatttctggataaattcatcagttacacttcaaatcatttacattagtctcggaaataaaaattaaggaacaggtatattttccatttttttttaataacaaaatttcattctatactatacccgaagttattaagagattgtgcaccacaattgttaatcagaaatattaatgaagtcatcaaaatgtgtttcgtatgttttaaatccaaattgagatcatttggccagacttaaaaatgctaggaccaaattcagtaacgaataactggaaatattattgcctattgaaagtaaatatacctaatacattcaaatttaatcagatggcccgaaaaaaagatgctagggcaaaattcaataacggagaatatcacatacagaatttatagaataacagtttttcattcgttgatctcactccaaattttgaaaaacatgtaaaaactttcactgattcaaatataatgatcattttggaaagagacaattttccaatgtctactcgtacaacaggaatggaattaaccaatagctcaagtaattcataatggttttaaacaaagcaatttgatcatttatttcacctactgatttttttgggaaactgtcaacaaaattataaaaacctgaaaagttataggggtactgcagcctgtaccagacacaccttcagagctttcgccgcatgcgaaatatccacaatagagtccaccatctcctggactgctgtgacagaaggaaactgcatagctgcctgcttagttttgtttacgctgctcgccaaagcatcagataatgcgttggcacaatttatagcgccctccttgatctccctacaagaaatattcttgtgaaccgtatctccaatgagtaccaacttgtgtgcgctcagtactacaaactttccgtgagccagaaatatcttaggaggttggttgtgctctacagtcttgataaatgcatctatagcatttgtgaggttggtatgatgtgtaacaacctgtgcagcataaaatgtcaacaattgcttatcatcagagtctaaaccaggagatttatgatcattatcgaaagcaattgaatcagcaatcttaacgcagttgtcatagcctttgcgaaggctctgtggtaggtccttaagaatttccgcgtggttcttagccatgttctcttttgagtctaaacttacgtagtcatattcctcaacccactcgctgttgccttgctgctcctttttgaacagcaaaagaccattaccttgaatgaaagatgctatttgccggatgtcctccgttagggctctggaacaggcgaccagttgttccagctcatcaggctttctaattttttcttcctctgcaggtcttgaaagcagctcaagtgaccaattgtgcttggctaatttttctgaagcttcctgtaccaaaatatcagaacgcttcaaggcagaaactagtggtgctagctttccggccaagttcttatccgaagcccgggcggcgtttcccagggtcccttctccaaactctgctaagtcgtgtagcgagacacgcagcctcgtcactgacagcttgatttccatcaaactaggctccaagcgctccttggttctccactgatgtcccacaaaacctaatagtttagatattgcgctggttgtgtcagtctgtagtctctccaagttttcaagagccgagttcagttcgagtgggagctctttagtcagttgcgaagggacatcatagtgttgaggcggttgtagaactatctgagggcctctggcgtatggtttaggaacatcatagtctggcatattggccaagctgcttcgattagatgaactcaaagagtctgccgtaagggaacttgctgaacttgaaggggttagttgattgttgggattacctattagggacctaggaatgtcgtaagcctctccggagtctcgattgattggtgaagcacatgagggggccggggagcatcggggacaatttcggaaactttcatttgatactggaatcgccggaggaggggtgtcgtagcagtcgtttacttgttctcgggggctcattccaggactaagtccagaaactgggaatggggaacatttggaggacggcatgtcatacaaatacacatcattgaacttcttgggtgttacaacctggtttgggtgaacgtgccaacttcttcgtttcccctgcctctgtaggaagttcatatctccattgtcggaaaaatgctgtggagaagagcctcgtccgacatcctcaaagacacccggaatcaaccgcagtcgattagctggacaaataccctgctttcctcgcaaagaacacagccaccacccttcaatattcgcggtattttgttcaagtacaataagagtatctcctcttcgaaactgcaactcatcaggtgtgtcaggaatattgtcatacaaagctctagccaaacagtgctgagagggaacatccattggttgaggcataacaaatttttagaaagatacataaactaaacttttcataaataaataaccaaattaaagataaacgaccaaaacatgccgcatcccactcactaccacaccacgaaccaactacaactcaactc

SEQ ID NO: 45 - DNA, 3836 bp, Leptinotarsa decemlineata
  Annotation=TBC1 domain family member 13; Tribolium gene name from OrthoDB database=TC002446; Blast E-value Tribolium Gene vs. Leptinotarsa Unigene=0
gatacaaaaatagagagagagaatagtacagtagaaagtgtagggagcagtgttacttaggttagagaatataaccttaatataaaggcctgaagaatgataacattggatttatgaagaattaaacaataattttcccttcaaaatatggctggtccatcaagtttgtctcttaacgatgcagttctgaagaaaacatcaaatatttcacctttgaaagaaaaagtttctggttatgattggagccatggtttagattataataaaatacttcagagttatttacacactggatttcaagcaacaaattttggactagcagtcgaagaaatcaataagatgatcaactgtagacaattaccaattcctaaagaaaaatttattgacaatgatgatgaatttactgcagttaaaaataattgtacaatttttttgggttacacttctaatttggtttcaagtggcctgagagaaactataaaatttttggttgagcataaaatggtagattgcattgtaactactgcaggaggaattgaggaggatttaattaaatgtcttgcccccaccttcatgggagacttcaacatggatggtaaaactcttcgagagtgtgggatcaatagaataggaaatttacttgttccaaatgataattactgcagttttgaaaattgggtaatgcctatactagatggcttattgaaagaacaaaaagacggagtcttatggacacccagtaaaataattgaaagactaggaaaagagatcaatgatgaaagaagtatatattattgggcttcaaagaataaaattcctgtattctgtccagccctaacagatggaagtattggagatatgatgtttatgcattcatttaggaatcctggtttagtagtagacattgtttcagatttacgaagactcaacttgatggcaatgaaatctttaaatacaggaatgatcatagtaggagggggacttatgaagcatcatatatgtaatgcaaacttgatgaggaatggcgcagactttgcagtttatcttaacacttcacccgaatttgatggcagtgattctggagcaaaaccagatgaggcaaagtcatggggaaaaataaaacctaacgctacttctgtaaaaatatatgctgacgccacattgatttttcctttgttggtagctcaaacatttgcaaaatgttttaagtgactgaatgaattccagatgtatatactaaagtggaaaaagtttcaaataaaacaagttttatatacgtttttgtaatttaggcaataagatatttataaaacttataaaaaattgagtatttagaaatatagaatatgtatacacctttaaagcaatttatacttttcggaaaacttggtaacatgcgttcaattatatacaagtgaaggggtgttatcaaattcagaatattttatattttgacaattcaactgcttttgacaaaattatctgaacatccataggcgggaaattttgtaggagtttcaaattggacggaaaatctccttctaataactgatttttcaatattataatcattgcacagcaaacgtgaattaaaaaatcaaatctattactatcagaaaacaaggagtcccatattctcagtacgtcaggtagaggaaattcttgagacaacaggagggtaatccatctaaaactatagtattggggtttcagatctagttgctgaaattttagccaaatatcgagatcacaatttttcaattgcattaataatctagtcatcattttgttgatgcctctctccgattcatctagacttttaatgaagaagtcccttatttcagacatcaaatttgtgaaacagaagaaacaatcggcttcagcgtattctctgaatgatatatcaggatcacaagcaaaggcatgatatatagggcctactatttcattcattccttgaacatatccctgtccaggattcaatttggcatacaaaaataatatcctctctactacttcccaatgagcttctccaccttcttccatgggggcgtaatcctcatttgctttttttattgacagtgcaatcttcgttattcccaatcctttcctttcaacgtttgcgcatttcaaaactcttctctgcactcttgtatgtaatcttttaacatcattactattcactatttcgctacatggaaattcagttggttgctgaaaaaatgatatgtccggacacagtcttctcacatccttatcaatttgcaataagacttcattatctttgaaaaaagtctgccattcactttccgggttgatactcaagggatgatcgctatgtgttacatctccactcgattcattctctccgggcatcacaatcatttcctttatgaactgtttgtacaagtttcgtttgtctgtgagataagattcccattttttctgatcgggaggcaaaaagttgagcagtaatctccagcaaagcgatctttttccctgatcgtctgggataccgttaaatgagatcttttttaaatgacgtatattgataacctcttcttgaagaacatcatcgaattctttcaatcttgccttatgtgccatttcttcgacaaaacattgaaaagcaagaagaatttgagcacaaatacaatttcagattcgaagaacccgaccaagagtttataaaaagatatcctcgtactttggaaggttccttgagaatgaaagacgacaggagaaaagtcaaaagacaagaaacgaaagaaaggaagaagaaagagaaggaggaaaagatgcaggagttgaagaagttgcaggagttgaaacgacaggaaatcgaggaaaagcttgacaaacttaaagaaatcacgggaaatgccagtttaggatttgaggacaattatattgacggcgactttgatcctgaggaacacgacaggaaaatgcaagctcttttcaatgacgagttctatgctgtagaggaaggcgaacaaaagcctcagtttccagaactagatgaagagttagagattgaaaattgggaacgatacgatgctgagaaagaagattctggcaatcaatgggacaatgaaaactttaatatggattgcgactacgatccccaagcttctgcaccagacgataccacagagagtggcagaagtagaaagaggcgcaagaggaaatcgagatttgcggcggctcttagcaaacccaaaccaaaatacgaccccagcgataagaattacgagaaatattttgacgagtattacaaattggattgcgaagatattgtgggggacatcccatgtagattcaagtacagacaagtcgttcctaatgatttcggactgtcaacggaggagatattacttgcaaacgagcgagaactcaacaaatggtgttcactaaagaaggccgtacaaataaggccggatcacgtggagaaatacgaacagatcgcttacaaaaaaagggacaaaatatcaacctcaaaatgaaaattctgccaagtcttttctcgaaagaacctgaaaacgttacgaaggaaaatggaattgaaatatcgaaagaagataagattgatacagctgcagttgaaaataatgcggataaaaaggaagatgactctaatgcagcacttcaagtccataaagaaactgtggtgaacaatgaaaatgaaagttcgaagaaaaagcgaaagaagaaagtaaaaaaagatgaaaatcaggttgtggatgaagttcccgttgaaggtgttgtgctgcaaacaaaaaaaaagaagaagaataaaaagaagaagactgaaacccagacagaagaggtcacac

SEQ ID NO: 46 - DNA, 1508 bp, Leptinotarsa decemlineata
  Annotation=Low-Mr GTP-binding protein Rab31, putative; Tribolium gene name from OrthoDB database=TC009462; Blast E- value Tribolium Gene vs. Leptinotarsa Unigene=4E-94
aagtacaggttgtggtaggaaatgtcaaaacaatgaaagttagtggttatggaacatttgactcatgtaaataaacaataggaaccccctcgagtgagaagggatttcacaagtttattcagatgaaaagtgatttcttttacaatttgaccaggaaactgatgttagcgaagaatgaaacacatcgttggaaaagttgtggtactagggtaccaaggtgttggtaaaactgcaacagtgacacgatatgtagaaaatacttttactgagaacaatgcgccgacagttggtgcttctttctttagcgttaagataaagttggaagatcatttagtaacacttcagatatgggatacagccggacaagaaagattcaaagcgatggcccccatgttttatcgaaacgcaaacgcagctctgttggttttcgatataacgtcggccagttcctttgagagcatgcagtcttgggtgcaagaagtcaagagaaatgtcgaagagaccatggtgctgtgtgttgttgggaacaaaaccgatttaaacgatcaaagaacagtgacaagagaggaagctttgcaatattctaaaagtataggagccttctatttcgaaagttccgccatgactgatcagggcgtcggcttgattttcgaaaaaatcgcccaagaactgttgaaattgtcgggacaacttcaaactctcaaggtttacgatgatgacattatggccaagtctagcgatttagaagcaaccgacactgccaacgaagagacagttaagttaagcatcaatagtatcgcccacggtaattcggtcagctcaaaatgttgttgatattgttttagtattctatttgtttcatgagggaggttagaaacaacctttttgtaagtgtagaagttttcggtgaagtttactgtttttgtacttgttaaccgaatttaattgaaactgtataactcccggctttttgtcaatatcacactttttatgctcgttaaagtataagtttctgacttagtaaaataatatattaaattagaactaaagacaaacacttgttaggttgttaaaaaatatattttcaattttattttgacttactaaaataatgactatcattataataactatgttgatgaattgtcaattgcatcgagaattgtatgtaactgtacaaaatgtatttggtataaaaatcagtttcattttattgtattatttgaccccgttataaataatatcgcacgctcctgactcttttaaccaagacgaaattgtgatttgttttttgtcgggaattttgataacgcagagttgatggctgtgtaatattattggttaatcaatcaattaactcacatatctacttatctactatatctaacattattttgcaatgatcgatttgatattcttttttggtattgtcaacttttgattagatattgttgttcaagagatgtttattatttatacgaactttaggatagtgaataaatatttat

SEQ ID NO: 47 - DNA, 2133 bp, Leptinotarsa decemlineata
  Annotation=Arp2/3 complex; Tribolium gene name from OrthoDB database=TC015671; Blast E-value Tribolium Gene vs. Leptinotarsa Unigene=2E-104
ggattattatggacattgtcattaattttcatcaaataactggccagtgtatttatacaataaaaattaacgtcgaatgaaaccagtcacgttgagataagtttcagttgagttgggaagcaggttcaccaacatttaagtgttaaatgtcaattcatatttaaattttcgactgagctattgacaaaaaaaatacaaaaaaattaaatcaactttagaaatgtgaacaagctcataatggcagtttaattctccaccaaaaaatcattgatttccttgcagcactagaaataataccccttctccctgtttttgctaaatacagtccaagacagacctcctataataaatactatgaacctgacaaacagaatatgataaatatatttacaactaggtagtctagaacattatgactgataattatccgccattcatctcggcaaatatatatccatttcaatggctctcattagtttagaaaaaatcaataagacttatcaaaatagatagaattggacctcaggctagaaatcaatcatcgaaaacacgtttcactcatctgaacaaaaatacaatctctcgacatgcgtttaactaacagagattactaaaaagtatggaaatagcaaagtgtggattgcgaataactatgaactgcatcacctgcaaacgccaccttggttggtgaaacgtgcattgagaagagtattgcagttctggtgattgagagaagtgcttgtcttggattcattctgagccagaagttgtagttttgagtctattaaaaatacttgtcctcagaagaacaaaaatactctctcgacacgtgttttgctaaccaagtaagcatcatcgggagacggcagagttttagttatctccttatatagctaacttgcctagcaaaacacccgttgagaaacagcatgttcgttcccttgaggaaagagtgtgtttattagcaaaataaatataatggtcaacactcaaaagtcaaaaaatgaaaattatcttgccaaatatctaaaattttagtcagctttgccactgatgaatatacatgtattccatctttcaggtggacatataaatttaacattgcattcatttctcgtttgatttcgtaacattgtaaacagaaccaacattataaaagctcttttgaaagtatcattcagttccataattatgatgtagtttgctaaaagaaacaatttggagaaaattacgagtttttttggaaaaaaaattgaaaaggcaaatgaacaaaagcccgcagcaagtaatggagaacagaaggtgtcatttcatgaattttcattaacaaaactgttcgaaacagattttactactctagcgtggccttatcttttgaagtgtactgaagcgcatagtattgactaattggtgatcatctaacaaaaatacgtaaatctgatgagtatttttccaaaaccaaagcgagccgatataatgaacatttaccacaaactgcatctgaccaaattatagatattagcacctgccgaaggtttcatcacgaacccattagaaacgtttcaaaaactcctcggacacgattctagctctagcattcacagctaacttcatctcagaaatctccttatcgatctcctccatgaaatggatgacgaagtcgactagcttgtgtttgtacatctgttctgtgtggaaattcgttatcaggaagctgatatcgtaaccatcgataggtttcctcctaagcactatgaaattttccgcacgcatcatcatgaaccgcatgaacttcttgcagaggattttctcgatctcgtctgcctgcttgacagcaatgctgatccttatcgagttgactgaagactctatgagcaccttttccttctcgtttctcgaaatcacgacgggattcagtagaagttctttcgagctcctaacctcaacttccggtttgttgtgtctttctaccacttgggaggagaaattgtcgaggcacatggctgcggtcagggtatgacgaactgctgttaggtatggcttgagcgtggccgacattgtggcgaaaatttcgtattttgatttacccaaataaccacacctccctcagccttaactcactgtttgacactc

SEQ ID NO: 48 - DNA, 801 bp, Leptinotarsa decemlineata
  Annotation=Elongation factor 1 gamma; Tribolium gene name from OrthoDB database=TC007229; Blast E-value Tribolium Gene vs. Leptinotarsa Unigene=1E-105
attcagaattctgtcaaaatcaaagcacgttaagtcttccattgaaaagtcaataattttgttttaaaaaattgtaaaataaaaacagccctgatttttcatctcaaacatacagagtatataacaaatcgttagcatacaatcaaataaaagttatttgaaaactttgccttgattgaactttctaccgcctttgtcggtaccggtccaagagaagtattgctccactaattttttagtttcttcggaactagcatctagttttttccagtcatatgattcataatctatttgccaatcggggctcaacgggaaagcaagctcctggcctcgccacacccaaacgcccgaaatggtgctgttgttatcttctccaaaaagacataccgacgcaaacgcctgcttacgcattttgtctaacctctggaacatgccggttatgaggttgcagctcatgaagactttggcgagttcttcgggatatttgtactcgcagtaccatatggagtagttttctggatcgaatttctgccagaagtatgggatggatttgctttcttcttcgttggagtagaatcttttgaaatcgtccatgtcgaaagtacctttgggcatagctgcgaaaggatcctcttgtttttgggtttctcttcttctagctcttctggttctggagcctcttgcttcttctcttgtttcttttcactcttcttctcctgtttcttttcctctttctttcctttaccttgagctgctggtttaacggcaccaatttgagctggtttactgcaaagttctact

SEQ ID NO: 49 - DNA, 4298 bp, Leptinotarsa decemlineata
  Annotation=Decaprenyl-diphosphate synthase subunit 1; Tribolium gene name from OrthoDB database=TC001148; Blast E-value Tribolium Gene vs. Leptinotarsa Unigene=1E-67
aacagtcattactttttattaccaattaaaaaattaacacagtgactcaaatatacatattaacaatatatcaataataaaaaataacagtacatatttatatacacttaaagaataataattactacaaaacagataacaaaaatgtgtttcataatttgataccgggaagaagtttttcctcacagtttaactacaactgaaaggtaccaaatcgtgaaacaggttgcttacaaaaaagaagatatctgctattgaaattaggctcgaacagtgccacggttgagtgtgttataccattgtcaagattctatccaataaaagtatatacagcgtggaactggtctttttttacacgagcaattgaataatttaatgagcattttatgaccaaaaaaaagaaaatcctaaacttaaatttcattcctcatgattatgttttttcaatatactgaaagtgaaaaataagttacatggcgtagccatcctgatgacccgatttgattcctaatactcaaacttcaatttggcttttacctcaaccaaccttaaccgagtagtttaaatgggtgaagcagattatgtttgacactttgggaattattatgagtgaaaaaatacaaaaaaagttttttgtcgaaatagtatggttttacaacaatgaagaaactcatatttcatattttgggtttcactagtatattttttacaatagattcagaattagatatatttcactatgcacgtttcggcttgataaccatcttcatgtaaagtggtaaaaacaaacatttaaattacttctattttccaatagagacaaaaaaggatgaatttcaaatattttgggctatagtgaaaataacgtgaaaagataataattgttttgaaatcaactatatttgacaaaacatttcaaagaattacaagtaaattaattaaaatgagtaggcacaaacttttcaatttcatagaccaaatttcatattcataatgaacaatgtcgctcaaatatattacagtgacagtgacaatgttactgtaatatattacagcgccataataagttctgaaattacatttaacaaaattttccttgaagtaacaaagtcattataatgaaatatgttgttgagaaaattatcgtttcaagtcatttcaggttattacaccgaaatttcatgtattaaaatatatatcaattattaaaagatataacgacattaaatgaattacactgatcttactgacctttcggtggtttcatagattgaataaattaaaatttgcttaatttttttatgaagaaaatagtcatcaaccaaagcaattctataaaaactctaaaaagctaatgtttttgttcacttccaattcgaaattctaattgattttttatgtattttgaccactttgtgtatttaaaaatgagtgatattatatatcttcactgacccaccattcaaaaaatcatactaggtcccattttttagttgatactccaataatatcccaaagtagagttcgaatcagttgccaccctgtatagtaattagcaatataaacttatttaatatccacaaaaatctgtacatctttgagttaatcttcctagttgctctcttccgccctaaaacatcaacgaaatcaacacactcacgcagaacaggcatcaaacattcataatcatttctaccacccgacgtgcatagcgaccaaaaatatcccgtttcaagtgtacggtgttacactgtaagctactgtagataaaatataggtgcgattaccggtcgacctttcaacagaaggactctgcattgttccaaaggcgaatactttcaggtgttccacaaggcacagtaccaagaccggtttcgtttgtcatctacgctcgataacatcgtcatatttacacaagaatatatatagcttgacatacaaagagagctacagagggagcctttccaaattattattggattactttaatgcctctattggaacagtgcagagcctttcacctcataaacatcaaacactcagaatcccatccatcaggaccgctcaacgaaccactctcaggtgaatttcataactacaagtaatctacctagaccgtacctattatttctgagcgttatttcatgcggttcagcacgaaatcggcagtgacgatgagtcccttctggtagggactttcggccatcaggttggcaagcctgacggcctcttggcagtgctgccgcgccaagaactgcgtctggtccagccctctggatttgtgcaccagttcgaaagctctttctacgtcgcctggctcttggaatctccgcattatcatcggattcaattcaggatatttttcgcaggcaaagagaacgggtgcagttgcaaggccaagcttcaagtctgccgctgtcggttttcccatcgcttcggctgacgaaacaaagtccagcaaatcgtcgactaactgaaatcccagtccaaggtttctgccgtactggaagcatatttcggtgatgtcctcgtcggcttcggccaatatagctaccgacttgactgaatttgcgacgagcgaggctgtttttctgtacgttttggtgagatagtgagcaaatctttcgttttcagtttctttcgatcctaactgcatgaattctccttggactagatctgttacaacctgacttaaaacagacgtgacttcgttatttctcaatcttgcgatcatcatagacgctacagctaggataaaatctccagccattgtgacttttttgtgattccacttgacgttgacactgggtttcccccgccgaaaatccgactggtcgatgacgtcatcgtggacgagtgatgctgtgtggatcatttccgatatcatcgctacctctctttgcgatgacaaaagaccacttttttccttgtacatatggtaatttatcgctttcgccatcaatatggcgaccatgggcctcagtgccttcccgtgtccatcgaagtagtatgtcgctatttcgtataaattatcttggaatgtatttcttctcaaggcatttctgatgtagtcataaacgtctttgaggtcgtcttccagtattacgtagggatcgacttggtagtcgggaagagagccaggctgttgcgtcctcatcgtggcaaaagtccgggcagttccggttatttcgggccttatgcaggggtgccaaaaccccgccgtcgtcaaagatgtggaggctgctgctgctgcgacggcattgtttatcgcttgggcctgtgtggtgtcctgcacaaagttcctgttcggcgtttgaaatccaaatttttcgcgcacacacgtcggtcttttcgtgatgatttgtgaatgtccccactgacacagtttctcgtgcacccgagcacaaattctaccagaccttatagaagccatcgccaagactgttgtgagacggcaatcttttgtgaagagacagttgtaccacctttccacagtccacctggtcgcgctaggcccgcctagtcccactctgtgactacggcagattacgaagtacggtccacctaacctccaagaaaatgtccgtctcactgattacgcggatcaacgtagccgttcaaagactcaaacagtctttaatattcgctttcggacatccgccagatgcgttttgcctcgctggtatcgaagtcgatcgtctgccccagacagcccccaatggtcgctgaaggacgtgataggcgatggcttcctgtgggcccagccgaaaagcaggagatccttggagaagaggatgaaaaggagatatgggcatcccgactatattatgaaaattctcagtcccaggaccgatttgaggacttgcaacgtttgcggggacgatcatgaagcaggagtactgtgtccaacttgttacaagaaggtcattgatgaaaccaaagcgatgcaggatgccatacaaaacgaattgaaactagagcccgtggaaaaagaagtagtagtgctctacgaaggcgaaaaggatggtgaaccagaggaattcttcgaaggaaagagaattgtagaaatgaagagggagaggccgtcgtggttcagcaaaaacttacttcagaaaagtactcagaagggagccaccactactgaagtcaaaccatctgaattgggatgaagaaatgcgttacaattggaattcacaagaaataaaattatgtggatgtgatcttttgatagttcttatgtagttttacatgaataagttttgtaagaaaataatataaaaggttttgtgttgtatcac

SEQ ID NO: 50 - DNA, 3642 bp, Leptinotarsa decemlineata
  Annotation=Uncharacterized family 31 glucosidase KIAA1161; Tribolium gene name from OrthoDB database=TC000571; Blast E- value Tribolium Gene vs. Leptinotarsa Unigene=0
aatttattatcttaatatcacaatatatgtgtgaacaatcatttgaatgggagacttaatgtacacaattttattgcttcaagactttttcaaagaaatttagagaatcccattatatatcataataactacaagatttttgcattttctggaagttacaggaataaaacaaaatatttttattacgacaataataattcaaaaaaactttctagcctcaatttatttgtcatttgaaaactagagctcaacctagtcgccttgcagtgaaaggcaggatgaatctcgccggcggggcggtcgatgtcgaagcttggctttgcaactgacctccttggggagccacgttcatttttgatatttgaggattgagttctgtccgtcccatgaatggtggcttcgtagggggggattgtcttctatcccccacagtcttcaccattgtgaattaataaaagattggaaaagcctgtaaattttattttcacggggagaaagatttttcctatggaattgtcaacatcactttcaaatcatattggagtatacataaatagtgaaaatattctgtctatccaagatgaatgtgaaaaaaaacttttcactttctaagatactgagaaatattccaaattatacatacagttttcataatacctacacaaaaactgtattcggaaacttgccagcttgcttgctatttgttgtggcacgtgactcatttattccacattgagttctttcttgaaaaaaacacaagatgataactctttcatctaggaacaattagagtagaagtgatgatatcaaagcctctggcaagttaccgcatgtctaaaaagttataaggtatattcaatgtgaggaaccattttttttattcgttcagatcttgactaaacttagctacacatgtatcgtatcataaaagaaagtgttcaaaaaataaaaatgaaatttttcagaaattctggtattttcatgtattatcaaaaacttgttgaattttagttttgatggtaaagtgcctcagtttaagacctacagattttttaacgagttgtaaaagcaattatattggctgctattagattaacagcttcttcgatctagtgcattgaagtgtagtgaaattcatccatcccaaaattctaccacagaagaaaactgaaagtcgggaacataactatcgttgattttctatattaaaatcttgtgtcatctggcattcgctcaaagtaagcaacttcgtttctctctacatggtaatcatgaatccatctactacccttcctcaaactcccatctataccgtctttccaaactccagcaggaagatacacttctcgttctctgaagccagaagacagaacaggagctacaattatctcatctccaatggagaactcatctactgcaagatggcaattgggatcctcagcgtctaacatccacagaggtctgattatgggcaatcccaggttcaaagataccctagcaaactttttcaattttggagtaaccttattctgtctagtgagagcgagattttttgctatttctgagatggtttcctcaccgtagctgctgggtaaatggtgatatctcacaacaggcaaaaaagcagcaagttgcagccaccttatgtataactcttcatctggaagtgatcttcctgtcccattagtgtcaatagtagtttcaggtccatcatagtcccctcccacagcacctgggataagaaatgggtaaccaagaattccataagtgagaatagttggtataacttttcttagaccatcccaagatgattcgaactgtggtaaaacgacaaaagctggcgacttcggtctctctacagcactattaaccccaaaaattggaactgaaccttgaagactgttgatgaagaaacttttatattggtcaggactgcgcaatgctctctcacattgataataatgtggcatgttgtaagctaagcccatgtcgaggtaatacgcatcgaacttgtatttctttctgacgtttttcaacttttccagtagccacggtatcgttctattattggtgatatcgagaacgcctgcactctgaactgttttatactttgttagcgccggtatgagtcgatcgctgaatctttcagaaaccaacaatcgcttctgtactgcttcggcaaagttgaagctttccgttgatatgaaaggttgtatggtgaaaaccactctgaatcctcttctggtcaacatctccatagttttttctaacgtaggaaaacgagaagtatccagttcaaaatcgccgacttggttttgccaaaattcgttgatcaacacgtggccttgtttaagtatcgccactgagttcgttatgtcgtcagtaaaattggagattgtttcttctgtcagggtttgctttgtgagcgaagtgatttcccaaagaggttccgtcagtaatgagtcgatgatattcccgtcttctttctttaatccgtcccacaaagtgtgttcactaagttgtgcatgcaactgggacatgttggaattgatgcaaatactgtaattcatctgagctgtttcagtaaatctgttgaagtatgcaaagttgtcgtactgggctctgatacaaaactctttcattggatgatctcgtattgatacgtataagggtgttttttcatctatgatgattgccgctccctttgaattgatgaaatatcgtttcaagacatttccccattcatgcttctcaacttctccagtgataaacggttggaaaaaatgatttgctttctctaaaggccaagcagattccgctgtttggcctcccccgtaccaatgactgttactcatgtcgaagcaatccgtcagaggtatgttttcattcaaggaaatccatcgaagattgtagcacttcaaatcgtctccaaagttgtggaaattcaaatacaacctggccctgtgcatccattccaaacacagactcccatcatctttattatcgattggaaggcagggtagaacggtatcataatccaaattaattcctaacgaggcatgaacaatttctacaccttcattgttatgtattttcattaacctcttcactttgttgaacttgatcctttcgaagtaagcttttgccaacactttttgattatacagaaaatacgctgttactattaaaattacgattgtgataaacagaagagttacgaagattttggttttgtattcaggacttttcttcttacgaatagtttgcggtaaattctgaattttttctttcaataaactcgctatagaattcaccgatgtgactgaattggctggggagttttctatgtcatcaccaggtggttttagcattctcgggctgagtactgattttctccgagcattacgagaatatccgctgatatattgaaactcttcatcatcttctgttggtgtgttcagaacttcaccgctcctctcaaaatcttgcatgtccacggttgatgtgaacattttcatgtcgtctaaatttggcaacgatatgctgttccttcttcccaaagcatcttggcgtttctctatttcagaccgagtgtccttgccttgttcatcctcgatatcctttcgatcagccattcctaaa

SEQ ID NO: 51 - DNA, 5692 bp, Leptinotarsa decemlineata
  Annotation=Polypeptide N-acetylgalactosaminyltransferase 5; Tribolium gene name from OrthoDB database=TC005702; Blast E- value Tribolium Gene vs. Leptinotarsa Unigene=2E-156
gagagacgtggtttctttcgcggtccgcggaatgtgcgacgtgtaaaattcttcaatcacaggtatcaaaatgaaaacagtaattttcaaaaaatcctgagaaaattatagttacctggtagttgggaattgaagaaaaaatactttagtgcggttgtttagaaaaatcatgttagagtaggaaaagcaatttaattgattgtttatattatttgaattgacatttttgaaaataatttcatcaatataaaaatctgtgataataataattaaggaaacaattatttgtgatgtataaaaattaaatagatttcaataaaatgttatatggcaagctgagaattcatacctgcagagtaatacttctaacctctctagtttggtttctggtggatgtggtagttttatctttctattcagaatgtcttggaggtgcgtgcaagaaaggacaggactcggaaattgtagcagaacctttagttgatagtgaaagtgattacaaccagagagaacaagcaggcaatcccaggagtggaacagatatttctggaggagttccacccacatataaaagtagcagtttacgaagatggcgacctgcccctcctattcttccaatgtctgggagggttggggaacaaggcaaagctgtgaacatacctcctgaaaaagaagcacttatgaaagaaaagttcaaactaaatcagtttaatttgttggccagcgatatgatatcgttgaacagatctttgactgatgtgaggttggatggttgtaaaaccaaaaagtatccaacccttctaccaacaacatcaattgtgatagtgttccacaacgaagcttggtcaaccctgcttaggactgtgtggagtgtaataaataggtcgcctagaccgctattgaaagaaattattttagttgacgatgcaagtgaaagagaacatttaggcaaaaaattagaagcgtatgtgaaaacacttccagttccggtttatgttcttcgaacagaaaaacgatcgggcctgataagagctcgtcttctgggagctaaacatgtgaaaggtcaggtgattaccttcctggatgctcattgtgagtgtactgagggatggttggagcctctgctttctagaatagttgaagataggaagacagttgtttgtccaataattgatgtaatatcggatgaaacttttgaatatattactgcttcagatatgacttggggaggattcaattggaagttgaactttaggtggtatcgagtacctcaaagagaaatggacaggcgaaatggagacagaaccgcccctctgagaaccccaacgatggctgggggacttttttccattgatagggactatttttatgagattggctcctatgatgaaggaatggatatttggggtggagaaaacttggaaatgagttttagggtgtggatgtgcggtggtcagctggaaatagcaacttgttctcatgtgggacatgtgtttagaaaatcaactccgtactcgttccctggtgggacaagtaggatcgtcaaccataacaatgctcggctggcggaagtctggttggatcaatggaaggaattctactataatattaacccaggtgcaagaaatgtacctgttggagacatttcttcgagacgagaattgagaagcaaactgaaatgtaaaagcttcaggtggtacctggaaaacgtttatcccgagtcccagatgccattggagtactattacttgggagatatacgtaatgtgcaaactaagaattgcctggacacaatgggaaggaagtccggagacaacgtaggaatgacttattgtcataatttaggtggaaatcaagtgtttgcttacacgaagagacaacaaattatgtcggatgataattgtcttgatgcaagctctaggacaggacctgttaaactagtaagatgccatggaatgggtggtaatcaagcttggctttatgatgtagtggacaaaaccatcaagcatgttaacactggcagttgcttaacaaaacctgacagtagtgacgtcaacctgcccctattgaaagcctgcagtttcggagagggtcagcaatggataatggaaagtgatttcaaatggcaagcaaggcaccaccaggaagacaactagacataccagtgggtgatgcagtgtgatattaattaattctgtaaaatattttcaggatgctgtggaatcctgaaaagtggtgaaaactttcatagcagttcaggaacttcttgaattattttttttaaagaagagtacaattacaattttgaattagtacaggattatcatttttgttgtataaattttttcttattcatccgatctgtacactgagtctaatcgaatttattttcagcaatatttatagaaatcttatatttttcgaatgttttaatatttattcaaataccttatttattatttgtatttgcattccactaaagatgaagtaacgaaatagtgcagcaggtatgcaatgcataatggagtctaatccagttacatttatatcatttctcccctgagaaataaaattgcaagaaactatctgtgacaggttagttatagatctatcacttttattttgctaatctaattagcaattcttcctgaaataagacttttttaacgttaaggaaatgaacttctttgtgaacgactgccatttgtatatattatatagaataattggtgaccaatagagttgaaattttcataatttttactaaataattgctcgtttagaatcatattttctcggacaatattactgcacaaaactcaattcatgaaaattgaattgggtgaggctaagcaaattagaattatcatatcaaagttttggacatgaaaaactaccaatttggctaatgacttttatatagaaaactatttgaatatgatttctaggaacaggtaaaaaattgaaccaaaatcgatatcaccacaaatttttatcgaaagtactagttttacggaaatattgaaagagggaaatattttttaatggattgaacagtgaatttgttattcttttccaaaatgtgaaaaatgtcaaaacctgattttgttcaacagaagtcctaagcaatttgatctgagaaatgtaaggaacacttaaaagttgaaagagttaaaagaaaatataaaaacctcccaaaaaaattaaattataaatcaggcattctggccaaatattctcaaaaaataaacaatgaaaatttcattatttgaaaactataaaaaatgggtcaacatatacggggtatatttggatactgcttgatttgagaaatttactttttgtatgttatagtttgaatcaacactatttgaaatgatggaatttaacagtggcaacatcttataaaaaaactctatcgtattttttttttccaaaaagtatttccactatcactaattgaaaagttggtttgttattcaggagaaatgatctgttgaaacaattgaacatccgattgaatgatatttaaaatcatcgagttatatgaaaatgtttttgttaattattgttcatcacttgggaaaatggtataccattaagtaatttctagaactgtattcacagaaaaagtaaattttgtagcactaattttaacattgatccagtatctaataattcttcaaataaattcacccttattcagacagatttgataaatcaataaaaacagatctaagtaaaaatcaattttaactaactaaattgattattttcatatttaatttttgtttttactgtttcaaaccattgtagatcaaaacgtttttcctccttccacgaaagataaattttgatgatgtctatctgtttaacacaactcaagtatactatcgcaaactaattacaaaagaagcagactggacagcagggaaactttcaaacaaaaaataccaactggaattattttcatcctgtcagtccgagctcctcaatagtttagtgaaagtcaatgtgagagttacatcaaattcagttgctggttagctgaaccacaaaatagttcggaacttttcaaactgagtagactcacagagatttattttacttgatgtcataaaaaaatcattatgaattttgaatattatccattcatatataatgatcactcttcaaatctatttacaatagattttccatcttgttgggaaggtgaaaaatatgtgacggaatcggccgatacttgatgaaaattcataacatattcaagaaacacgtgttgaattttcgtaaaactttggtgaaaatctcacatgaaatgtttcttgaatatggtgaaaagtaaaacccacttttaacagttactttttgttcaaaatggctgttcaaagatatttttatgactatttatttcatctacatttttggtattcaaactagtttcaccttgaaagtattaggaaatgattgaaattaaattgcagaaatatttactgttcccagcaaaacaaatacatattattttgaaaataataatattaagtagataattgtgtccgaatttgataactgatcctcctaactcatgtagaaaactgtaaaactcgccaaataattgttacttaaaaattttcattgaatattgtttgctgttaatttaggttaaatgattgcacaactgtaagacatacacgtaattttaaagaaataatgaaatagttaccaccttcataaaatgtaagttaaaacttcggaacatttttctgttttccattcgagaatcaacttcacagaaattatttctttatgaatttttaaaaaatagagaggaaatccatttgtaaattgtttttcagaaaaattctgataccctttcctgtacagtgcattactaaaataatcagtttttttcggtattaacagcattatagtattagccttgtgttctggtaaataacaccctgaagcacctagggagtaatgtggctagtcggagtcccatcagtcatatattctagcaaaatcaacccagcatcaaccataaaaattatactgatagggcgataccacttgctcgaattcacccttagcattagtaattgtgtacattattgttcctgataagtaactttatttcttaaatttcaaatcgaaactcttctactaatttgatatttatatcagttgtgcaatcctgtattcagtcagttttaccagtcatttcaaaataatcatgctaaaaagattacaaaacaatcttataggaaagaaattcaacaaatcataatttcaagaacaaattatatgaatatgagtgaaattcaccactacatgaaagactataagattactctatacagtttcatatagaaaaaaacttattgtgaactgtgaatatcgtaatgatggtaatgaacaatattgtaatatctattcgctacaccttttcagcatggttatgtatatttatatcattgattcaatttattcaatatttatttgtgtatagtttgtctttgggaacatatcatacaatgtaaagcctagttttttacaccatgtcggttttatagaaattatgttttgtacctttgattagtttagtgtatctattcaaattttaaaggctaggtggtggtgcaatccagcttactaaattaagatatacaaacatttcttaaataaatgatga

SEQ ID NO: 52 - DNA, 2133 bp, Leptinotarsa decemlineata
  Annotation=Heat shock protein 68a; Tribolium gene name from OrthoDB database=TC004425; Blast E-value Tribolium Gene vs. Leptinotarsa Unigene=0
cacaataacatgtaacaaaaaataaatcagtctttgtgtaaataaataatgaggaactttctatttaaaaatactgtaaaaattgagtacttattgtataaaagcttttaaacttaatcaacttcttcaatagttggtccagatcttccagttccgaatccgcctgcttgctgtccacaacttccaggcattccattggacgcatttcctccatactggttgttgttttgttggcccccactataaagtttggccatgatggggctgcacatcgatgttaactgcttctgcttgtcttcgtattcttctttctctgccaaagagttgctatccagccatttcaggcaactttcacattccctttcaatagtagacttgtcttctgaagacaatttgtctccacaatcctgtacagcttgtttcagttggaagacataaccttccaactgatttctagctgcaagtctctgtcgttggcgttcatcttcctccttatatttctcagcttcggccaacatcctgtcaatgtctttctgtgacagtcgacccttatcatttttaatgactatgttgcgggagttgcctgaactggtgtctttggcagatacatttaggattccattaacatccagatcgaaagttacctcaatttttggaaccccacgaggtgcgggtggaattccagtcaagtcgaaggttccaagaaggttgttgtcttttgtcatggctctctcaccttcaaacacttgtatagttactgcgggttgattgtctgcataggtggtgaaggtctgcgattgcttgcatggaatcctggcgttgcgttcaatgattttcgtcatgactcctcctgctgtttcaatgccaagagatagcggagtgacatctacaagcaagacatcctggatcttcgagtctgtttcaccgctaagaacagctgcttggactgcggccccataggctacagcctcgtcaggattaatggacagattcaacgatttgccattgaagtagttctgtagaagttgttggatctttggtattctggtggaccctccaacaaggactacatcatgaatctgtcccttatccattttggcgtcgttcaaagctttctcaactggctgcagcgtccctctgaacagatcagaacagagttcctcaaacctggctctgctgattttggtgtagaaatcaatgccttcgaaaagagcatcaatttcgatggttgcttctgtacttgaagagagtgtacgtttggctctctcggctgctgtcctcaacctgcgcagagacctaggattgcttcggaggtcctttctgtattttctcttgaactcatctgctagatgattgactagacggttatcaaagtcttctccaccaagatgtgtgtctcctgctgtagccctcacttcgaatagagatccttcatcgatggtcaatatggaaacatcaaaagtgccaccacccaagtcgaagatgagcacatttcgttcacctttcaagttcttgtcgagtccgtatgctagagcagctgctgttggttcgtttataatcctcaaaacgtttaagccagcaatagcacctgcatccttcgtggcttgcctctgggagtcgttgaagtaagctggcactgttataacggcatctctgatcgaacttcccaaatacgcctctgcagtttccttcattttagtcaacaccatagaactgatttcctctggagagaaagtttttctctctcccttgtgttccacctgaattttcggttttccacagtcattaaccactttgaaaggccagtgttttatgtcctgttggattttcgagtcgtcgaattttcggcctatcaaacgtttggcatcgaagacggtgttgctcgggttcatcgccacctggtttttggcagcatctccgaggagacgctccgtgtctgtgaaggcaacatagctaggtgtcgttctgttaccttggtcgttggcgatgatctccacttttccatgctgccacactcccacacaggagtatgttgttcccaagtcgataccaactgctggagctttaaccatttttgtttcactcgttgaacttttcactgaataatactttgaactgtatatcgcctaaaat

SEQ ID NO: 53 - DNA, 7595 bp, Leptinotarsa decemlineata
  Annotation=Insulin-like growth factor 2 mRNA-binding protein 1; Tribolium gene name from OrthoDB database=TC013744; Blast E- value Tribolium Gene vs. Leptinotarsa Unigene=0
agtgttcctcagagacttgttaccatcctgtcgtgattttctagtttttctcgaggagaaaaatccgtcgttttgtaattcttcgaacaggtgtcgtttttgaattgaatgcgtaataagtttttgtgatggcgcgacagtttacgtaaagtgaacgagttgttttgtgttttggtttataacttatttgtgtcagcagatgcgataacacgaaaatgtcgatctattttagtcaaacgtcgaagatcataatttcgaatttgggtccacatgtcaggttcgaagacatcgaacatctcctcaacgaacaagggagagtagtgtcatgtgacaaattgacctccaaggaccccagtacgcagaccgtagctgttacgtatgaaactacagaacaagcgcaacaggcggtaaattcccttaatggcgccgaagtagagggtaaacaactgaaagtcgaattggctgtagaaaacggggcggagaggtcctcggggtccgggtgccccctttggggggttacctgggcagagcaggcagacagactttcccttaaggatcctggtgcaaagtgatatggtgggagcaattatcggcagacagggttcaactatcagacaaattacgcaacagacaagggcacgagtggacgtccacagaaaagacaatgtgggttccttggaaaaggccatcaccatttatggtaaccctgaaaactgcacgaatgcgtgcaagaggatcctggaagttatgcagcaggaagccaataacacgaataaaggagaaatatctttgaaaatactggcccacaacaacttgataggcaggatcataggcaagggcggtaacactatcaaaaggatcatgcaggacaccgacacgaaaatcaccgtgtcaagcataaacgacatcaactccttcaatctggaacggatcatcaccgtcaaggggacgatagagaacatgagtcgagccgaagcgatgatcagttcgaaattgaggcagagctacgagaacgacctccaagccatggcaccccagacgatgatgttcccgggtctacatcccatggctatgatggccactgctggaattggatatggatcaagaggcctctacactggacaagctccctatcctggcatgtaccctgcaggatcgtctcaagccggtggcgatacccaagaaacgacatacttgtacatacccaacaacgcagtaggtgccataatcggtactaaaggttcccacatcagaaatatcataagattttccggtgcctccgttaagatagctcccatagacgagaccaaaccccaagagacgcaaaacgagagaagggtcacaattgttggctccccggaggcccagtggaaggcccagtatttgattttcgaaaaaatgcgagaggaaggattcgtagctggttccgacgacgttcgactaacggtcgagataatggtgccaagttctcaagtaggaagaattatcggcaagggcggtcaaaatgtacgcgaactgcagcgagtgaccggcagcgtgatcaaattgcccgaacaaggcgcctctcctcaagaagacgaaaccacagttcatatcattgggccgttcttcagtgtccagtcggcacaacgacgcattcgtgccatggtcctgcagtccgtagtgcccccgcaaggccggcagcgccccccaagaccacagaaagatcccagtcaatcggaaggtacatcatccgagccacaacagtagtactagctagagcaacacaaacactgcctgtgcgcatgggtttcaccataccctattgtacacgaaacgtctcttcgatgccttccactcgtttcaagaagctccaccccgtacgacaagcgcaggtcgtgcttccaaatgagcgagggtgcgccttgagtttttgttttcttgatttttttttgaatagttattatatagttgagttgatatatagtggaaagtctttgacgggaatcgtcctggaataaggtatgcgtcgaactacgtgcctactaaacagaatctacctcaaataatcaaaatatattagattatatagccactgaaatttccgttatttacacacaacaaacatacaaccgaacaaccgcatatttttttttactattacctgaacttctgtggacacaataaccaaagataccaagccgatgttcgacagcaagagtccagtcatcgtgaacatctgaagaatttgcacacacactacatcaaagaaacacaagaggcgtacagttccttcggagttaacgtggctgttacatttttttactactactaccgtaataaaatacgagtgtgaatgtgaaaaaaaaagctttaagtaactatttcggaccttgttttagtttattagtgtattgtgtttggagctaggcggtagatggtgcgtcgatagttgcgattgtttcgaaattgcgacgaactctttgccaagtcgccggggagtttatttggccgaacggcattcggacgaactgtcgttaacaaaagtaccgcttagccccaattgtgactgtactacaccggagaaggtaccgcgatacctaaaccaaactgaaacttgaaaatggacaacttcgtgtgcgtgaatgtggtgaaaaatagacattttttaactattatattattgttaggcgatttgttgaaataaatgttattttccgtcggttcggggtttgggcaggttccgaaaaatgtattattatttgttggagtgtcgggactgtcgcccctccccgctccgcggaagcatgcaaaaaaagagcggtgaaatttagatatgccaagatgtaggagacgagtacgagaggaaaacggcctccttgaatgccttgcgtcaaggcagttagagagagggatcctctcgttcctgatagtacaaactcgagaatatagatggcgttaggacagaacgccaggccggatttcgtgcgggtgggttattagggatcattcgtcacttgaatggtgtggaggtgcctccaatctagcccctactctgtttactttttttgtcgaattaagttggtggtttcgtattcccagctgtttcttcatcaagatatttcactgccaagccgatatgtgcctagtcagtgttgagcagtcgcagggtttgatcatcttttaagtcgtaaaatataattgctgattgagaacaatatttcatctatttcgttctatttgaacacacgtcgaattctactgaagagcatattcaaatactatttgtcagattctttcttctgtttgattgaaaaaaaatcaaataggaaaaaacatcgttaaaactttttgatgcaaaaggtaggtttaggtttttttgacaaactaggttttatttcagaatgctatttccaaacattcgtttggaaatagagaaacatgaaatataacggcaaatgaaaataaaattttgaatcgctctctgatgccatttttcctatatgaagaaacttctatttttttttcaatttgaaagtattctgaattcttaaatcccattgaattcaacaactgaaatatttgaataataaactatgttactgagataaaaaagcatggagtttacttttttcgcctggttttaatgcccatgttatttgacgtgactactaaagcaaatgattggctgactttttgtggcgaacgatccctaataacgcattcccatgaaaaaccgcgttgtaaaataactatttttgataaatattgtttgttggggtggatatctttttgttagatttttaaaaaaattttagacgtagcggggtcgctattttaaactaaaaataagaaattgtgaaaaaatggatataaattattatattgagaatataaatatatttattacttttgtgtataaaaaaaaatgagaagagaaaaaaattttgaatcgtttgtacagagtttatgaaaagagtgccaaagtgcaagaaatgttaccaggagagcttgctttatttatgataaaaaaaaatgttagtaaaagggtacatatatttattttcggcagaatgaagcatagagaaaagaaacactcgtcatccctctcatacaacattctttcgggaaactctcgcaaaagccatctacagttaatgtggtaatgtagaaaataaaaattggtaaaagatacaatcatataacatcgcacaaaacaaacgacttttagtacaaaatgaatgtaataaacaaagtgtagaaacagttccaacattcaaatgatccatttttcacagaagataccatcagtctattgagaaaatctaacgttggctgattttctttcatctgccttcagtatcttgtagcaggtgaaagaaatgaagagctgtcaattttcattatttttccatttcaaaattatcgtaacaatcaaaacgttactttctgaccccccaaaacaaaaaaggttgattgtaatactgaaatgatcaccaagatcaccaaatcacgtaatcaattgctaccaaaggcagtctacgcatacgtatatgtttttcaattgagttgagatttcatttgtgtcaattcatctaccaaagaaatcatacacgctaggaaactagtttgaattttttcttcacacaattgatactttctgttttttctgttacgttttcaattattcgatttgttttcgaaaaatacgttgcaaatagagtttgtggtcgttcttcaaataatttgcttgaacgtcagtgccagataaactccacaattccttttcatcctgagagccattatataataatttttgattattcctacagggcgagtctgaatgttgaatattcagtggcataggaaatgtcgtaaacaaatcaggacatgtataaactaggaaagctttgtgatgtttggttcgccctgtatctcacacgtgtgcgaggacaaaaagcgttctcgtaatacagaataatcactgcttatactgggcgattcaaatgtgtccatccgttagggcttgagacatattataatgtacacggaaggttgaatggcaccaaatcagggaaataaacaattatgaaatttttactgcttccaaagtttcaaaaagttttctgcagccccttcaagcttcaataaaagtgtatttatttttcaagaatgaattccatgcatctaaatgtgtcaagcctattctgtttgagaattccacacggatgtgacatttgggtcgctctgtataggcccgtacgaaaattactgttggtcgttgacttaaaaaagatgactgacaatccatacatatacaaagttatggtatttcatagtgcctaccataaattccgattgagcgattgatttcgattggattaatattatgtaacacaaaagtttgacctcccggctatattgtgtgaaccgtttaatattttgtcgatatcataaaatgaaaaaaatatatataataataatcatagatgttgtgaagcgtgaggcaacttttgtttcgttgtttaaatttgcgtatttcaagtgattgtctgttttgacaaatgtcgaattcagtcgtctcaaatcgggatcgcgttattctatagttatagtttttctttcttgaagttatgcatttttttttacatgtaatttttacgagtttcatagatttctgacgtgtccgaaaaagctacgttctgcaggcgagttactctgttacgtctacttggtgtttcaatgcattgacttacatattgatttgagatctgaaggaccaaatatttcgacagttgatcgaatttatggcatgacattttggagccttcaaagtgtaattgatttcgaatttcttccgagattcgcaaaaaaattcattttaaatatttggaaagaatatcggcctcttacgcaacaaatatctttgaaaccaagaagtcgtataacaaagaaactcgtccttccgtaaaaatacatagccgtagaaaagccttggtttgggttaatctgactttcttttttcccgatatacttgaagtaacatcaatccccgaaggaattttcgttaatgagtagctactcatgtgagtaatttagaaacgtccggattaactcaacagaacttttctgaccgagaaatcaaagtcattctatagtatatagtacatatattatcatctggtattttttatatttaattgttcgggtgagtgggtacctctcgacaatcagttttagtattttcgagttaagcctctcacccactgtggcttggcggttttcaacttctttgtttgttccaatagataaatcatgtcaaatcagtaagttccgatatggctcgacatctgcgggttggaaaccgttacttccacattttttaaaaccactatagtttatagtacatgttacataacgctagacggagactgatgtgtgcaaaccagcccgctgtagaattagtaccttagtaccggataaatgtaccgttttcagccagaatattgttcgtcttgcaccttatagattcttttgtcttttctgtcttgtcgagttataagctgatgatacactcccgtacgaatattttgtacaatatccgaaggactaaggaataattattgaaaaaaaaacagatgtaaactacctcagtaattatatatttgttgttcatgttttaacttgggtattgatataagtttatattttacttatggtgaatgctatttgtactacaacacagtttatatattagtgcatagttgcgagtttttttgaggtgtgtcactgtttttgcccagtcgagctttaaacgtgcaggattcagatcggttttggtaaccaccaagaccagtttgatgcaaatcttattaatgaatctacaaaataataaaactctgcttcctcaatctgttgcaagttccggagagccaaaacatatgttgaatgtttctaggtgtaactctgttgaggtaattcttttctgcagatcagggctgtggcacatccaaattaatgaaccagaagtgtgttgtgaatcaaaacccacttgtatattgttatacttctactgttgtttctggtgctaactactatattattgaaggtgcttggtggcaattcgacgattgtcgccgttatcgttacacctgtaacataggtaggatcatctgtggatttaggaaaaaatttcaaatacgaaaacgaaactggtgcatgtttcgacgtgccgttttttgcggttttttcctgtgccattgtgtattttattgtatgtcaacatctacaacgcagccacagagttcgaaatgatttctcaggaatatcagctcaggtaatttttttgaattggctttatacctacggatatctagtagggttaagtgatttttctttgaaatggtttttacacgctcccgtttgaattaaatgttacacctctgtagatgatgatgacaagaaatgaacagtttgtcatgtggttaatgtataataattttagatacttggcgatcattttccagacaaataaacttgttttttattcaatatggcatacttaaatccaaagtttattacacacacttatttcagttaaataaataaatagtgtt

SEQ ID NO: 54 - DNA, 1903 bp, Leptinotarsa decemlineata
  Annotation=Paxillin; Tribolium gene name from OrthoDB database= TC010609; Blast E-value Tribolium Gene vs. Leptinotarsa Unigene= 0
tcaacgcagagtacgcagggaagacaacaccattgaaaggtaaataactgacttatgttgatttgtttagaggattttgtttccaaatacggtgatctcaacattaactcagtatttctgtgaatttacttgggagactacattcaattatcaacaatggatgatcatttagatgccttgctagctgatctgcaaaataccgtatcgggttcaacgggagttgggtcaaactattctgggtatggccagcgagtaactagacagtcgccatcagaaattgagagtcacgttttgaaatccgacagttatggagtgaaatctggaagttacggcaagaatcaaccaccgacttccgacatgcgaagcccagggtacggcatccgcggaagtcacagttcggaaccgtctacgatggaaaaacaacgggcgttcaacaataatttggatgaactcgattctctcctcttggatctgagtagcaagtatgggacgtcgactccagataacatgaatggctctggcggaaactacaatggatcccttcacgaatcaggagggcgcagtcctgccaactattcaagaccctctagcgcccaaagtactctcaataggccttctgtcgatagtcttctcgacgaacttaattctggtaatgttatatatgagggtcccaagaaggttgtgattactgtaaaggaaacgaaaacggagaccggttatccaggcgagacagaattaatatcttcccaagtcaccgctacacatagcccggcagcttcaacagctaccagagagctcgatgacctaatggcaagtctgtctaatatcaaggtgaaccaggggcttcaacaccagaccgtctccgattcgcagtacgcgctgcccatcaaagcaattcaatcgcaaagcgctcccccagcaaagcagaacttggattctatgctagggaacctacaggcagacatgagccgccaaggagtcaacacaagtcagaaggggtgctgcaacgcctgcgacaaaccaatcgtcggtcaggtaattacggcacttggaaaaacctggcatcccgagcacttcacctgcgcccactgcactcaggagctcggcacgaggaacttcttcgaacgggaagggaagcccttctgcgaaccggactaccacaacctgttcagtcccagatgcgcttactgcaacggtcccattttggataaatgcgtcaccgctctggagaagacatggcatacggaccactttttctgtgcccaatgcggcaaacaatttggagaggatggtttccatgaacgcgaaggaaagccatactgccgcgatgactactttgatatgtttgcccctaaatgcggtgcttgcaatcgcgctatcatggaaaattatatttccgctctgaattcgcagtggcaccctgattgtttcgtatgcagagattgcaagttgcctgtccaaggaaaatcattttatgccgtggaaggtaaaccagtatgtccaggatgcattggagctgaagaagaggaagacgaataaaatgccaactcttatgccccttctcaaaatatgcccttcaccctataaaaaatgccccctttctgaaatgccctctttctgaattgcccttgaattttattgtagaaactatatttatattttaataaaggttgataaaaaaagaaaatataaaacaaaacaaaatatcaaaaaaaaagagatcacaagtaatcaaaaaaggcgggaaattccgaatactctgtggtgtggagtgtatttctcttcactgtgaagctcgaggctcggatattttcaaagtagaatttatttttagatagcgtctgcatgtaaatattacattacaccagatttatagttctgcagcttgtggtctctctcaccc

SEQ ID NO: 55 - DNA, 3189 bp, Leptinotarsa decemlineata
  Annotation=Na[+]-driven anion exchanger 1; Tribolium gene name from OrthoDB database=TC030633; Blast E-value Tribolium Gene vs. Leptinotarsa Unigene=0
taggattgtgcccatagttttaatgttattaagtacaattgtcattaacgatcattgtgggaaggagtgtttgaccgtgtatttgttaaacccttcaactacgcggttccttcaatatccgcttgcaagtgtcatttttttcaataactaattttggacccaaaatcagcctggaaaatcttgcacagaatccaatcggaagattatcgtttgccaatctcctcttatttgatctttctggcatgagatcgtccaatatttgtagttcctgtctggtgaaaatacagtcgaggaattttctgatgacgatcatcaccaccaacatgaccggaaacagaattgatatttgactgaatgattgtaccacccacagagaaatcaaacaggcgagttgaattatggtaaaaaggtggaccctcttgagtggcacctttctgagaaacatataatccggttgatatttattcgacataaacataatcaaaatcctatcaaaaaattccagtcctttcaaagatgatattcccatatataaaaagaccccaaataatactggcaatggtatgtgtcctaataccggtgtcagaaacaccgacaaaccgattgtgagaaagatcataatatgcgtgactctttgttctctaactcccaaaaattttggtttatctcctggggcggtacactcggactcttgtttcaacgaatgcacatgagttattgacagcacggtagcggcaacaaaccaaggaagaccaaagatggaacatatttctattagtattgatagaacaaaaaggtccaaatggtatccacaacctttcctcagtttgaactcttttctgttcactatcacaacagtaatctgctgatccatgaatatcaagatcgtcccaagtagtgctggggcaattgcaagtggtatggcatagtaagggttttttttgaaaggaggaacgatccagcctctattcggtaaagttggcttgaattcatatggaacttccagttttggggtcggtatactgacattgaagtccaaaattgtcatgataaggattgctatcaaaacagaaaagtcactgatgaatagtcgaatctttgtagaaaaaaatgaggcattcttgaaatctttgagtttgatggaaattataaatgttccgaaaaataacagaatcgacatgagaaatacatttgaagtagattttgatgtaagacatctttcagagaaagtactattgagttcaaggcattgtgttctacgggagatgttttcaaatgtattcgggaaagtagtagatacattgtcgttgataaaacacaggcaatcagtgcctgatatgccgatggggtacttctttcctatagccattacattttcgaatgccttgtaaatgaatattaaggcaaccaatgtcgcgaagttttcttctgtgaatctcgttatataacacacgaaagcgctagcatcaatagcaaccaaaataagaagaattacggcaatccaggtaccaatccagaacctgaaggatagatagtcccaatccatagtatggcagaaatcgtagacgatggtttcgaatacgagaactggacccgtagatcctaaaatagttagcggttgtccggagaagaaaccataaaaaataccacagatgcacccagatacaagtgattccatggcagccatatgacgtccagtcgcttcagaaagtaatccaccgaaagtgatgattggcgaaagacaagcaaaatagagaaatatccacgaagctactgattgcaaggctaaagcgtctctaaagtcggaccaataccatggagctttacgtttcaaatcatttttcaaacctccaaagagaatccctgttctagccagaccagtttcctcccttaatttctctttttcctctatttcgtcaatgattccattatgttcctcaggaggtcgttttcgaaattcttgggaaggaatgtttgctggtggttctattcgtatggcaggatcccattctccgggtgggaggacaatgactgcactcaaaaattcatccaatcccattaataaatgatctttttcatgcgcgccatatgccacttcgctaaagacatcgtccgacatgagagttgccattgctcgtccaatttcatcataccctgcagttgcagaatacggtccaatgagtatgaacaaaaatcttgttggtaaaggaacctctgtgagattgtccagtatgactcctgtattgagtctgatgaacgctgatatcggtttgtcaaggaagttcacctctcctactaaaatattggtcgcctccgctcctggtggaatttttcgcatgaacgacatattgcttttatattttctttggttgtttttccgttgattattatcctcgcggttcctaaaaccatttatagaatttgaagaacattttttttttgccagatccatttcatattctgattctctacgttctgaagaagtgccaaagcacaccaaacttgatccattttttccattgaggaatcccttgaatggaaacccttgctgatactgatgtatgtgtcccttcaacaaagtttctcttatctttcccttctgctccagggacaatatcttattattatttgtatcctccaaaaccaagtctgcaatctgctccatggaagatgcctccatatccaatataacgatctccttggctatgagccttcttaattcaaacaatgatttcaaggaaagagatgcaacataaggtttagaccaccgattaccttcttcaacgtcttcttcaaattttatccatctggcagtttctttccactttacatcatcaccttctataacaagcttttctatttcagagaaaagggggtgactctcatgttttatattttcctctatgaagaaacatcgaagacgctgagctggtgaagtatcttcagaatcgcctccaagaagcggataacccacttcgagatctcctttcatacactttgactcttccatgtcagtttcggaaaccatactgatcattcttctataaaaccattttatccattgattcccagtaaatatataaacaaacaatcttcaccttgaaatcttactaagaggtctccgaattgcgctatgaatgtatcaacgaaggaaacatctgaacccgttcgacgcacaacacaaactcc

SEQ ID NO: 56 - DNA, 2455 bp, Leptinotarsa decemlineata
  Annotation=Eukaryotic translation initiation factor 3 subunit B; Tribolium gene name from OrthoDB database=TC006009; Blast E- value Tribolium Gene vs. Leptinotarsa Unigene=0
gtgaaaaaagctgtctaatacttttattgacatccgcttcccaaattgtcttttgaacctgtgggctagagcgtgtcaaaatggcgagaaaaaaatccgatgaaagaaatagtcaaaatgatgaaaattcaaagaatgagaatgagttctcttcaaatgaggatgaaccaaatttcagtgatccggagggatatgttgacgatatttcagacgaagaattggtcggagatattctgaagcagaaaccaaaggaaacagatggagttgagagtgtgatcgttgttgatggtgtgccccaagttggacctaatcgtatcgaaaaattgaaaactgtcattaacaaaatttttgcaaagtttggtaacatagtgaacgagttctatccagtaaacgcagagggacatactaagggttacatattcattgaatattcttcgcctgttcacgctgcagaagccgtaaaactgagcaataatttcaaactcgacaagcagcacactttccaagtgaacttgttcaccgattttgccaagtatgagcaaattcccaacaaatgggaaccgccagagcctcagccttatcaaggtcaagctgatctgcattactatttgttggagcctgatgcatatgatcagtttggtgttgttactgcatccggacaaaatgttcagatttggcagaatagtcagccagaaccgacgatcattgaaaatagaaacagctggtcccagactcatatcaagtggtctccattgggcactttcttgtccactttccataagttgggtattgcactttgggctggacctaatttctcccaatacaaaaagtttgcacatcccaatgtacagtggattgacttttcaccttgtgagaagtacttggtaacattttctcctcagggggatcctcacaatcctgagatgaaaaaaattattatttgggacatcagaactggccttgaaaaacgttctttcaacccagaaggaacctctacatggcccattttccggtggtctcatgacgacaagtattttgctaggataggacaaaagaatgattctttacaagtatacgagacaccttcgtttggcttgttagacaaaaaatccatcaagataaatggaataaaggatttcaattggtctccaactgacaacatcatcgcgtactgggttgctgaagacaaggatgtgccagccagcgtaacattattggagttacctaacaggaacgaaataagaaaaaagaacctgttcaatgttgccgattgcaaaatacactggcagaagtccggagattacctttgtgtcaaagtagacaggtacaccaagtttcgtaaagagaaatcggagttgaaatactccggaatgtactgcaattttgagatattccacatgagggaaaaacaaatacctgtcgatagtgttgaatgcaaagagccaattcaagcctttgcgtgggagcccattggtttgaagtttgccatgattcacggcgaaacgcccaacatcaatgttagtttttatgaagtcagaatagggcaggcccccattctattgaagaagtttgaaaagagggcttgcaaccatttgttctggtcacctggcggtcagttcattgttctcgcaggattgggatcgaatggaggtggttcattggaatttgttgatactaacgaatttttggtcatgaataccaccgaccacttccaaatgtctgatgtagaatgggatccgactggaagatatgttataacaggggtttcatattggaagaccaaagttgatacaggctactggatttggtcattccaaggaaaaattctgaaacgttataatttggaaaaatttgctcaagttttatggagacccaggccacagacgctactgtctgaagaaaaacaaaaggaaatcaagaaaaatcttaaaaaatactatccacagttcgagagtaaggataggatgagaatgtcgaaagcctctaaggaattgcttgagaagagggctgctttgatagaaaagttcaacgaatacagaaaagcgaggattgcggaatatattgagaataagcccaggcggttggcacttagaaataatatagacacagacgagctaaatgctcataaagaaaatgttgaggaggaagttgtcgagttctttatcaaggaagaaatcacggtgatcgattaaaacatttttgttttgtggtttttccctgcttgtgctttttagcacatacagggagattttttgagtctaacatctataaatagcccatatttatcacttgatctctgctgcattcagagctctgttcattattatacttttcttgtactgtactggttctatcttgttcagtcaattaaagatttatatttttgacgttatgtattattttaacaggttgtacttgaaagacattgttcactacctggttatagaaatagatt

SEQ ID NO: 57 - DNA, 3673 bp, Leptinotarsa decemlineata
  Annotation=Lipin; Tribolium gene name from OrthoDB database= TC010029; Blast E-value Tribolium Gene vs. Leptinotarsa Unigene= 0
gattcataaacaaggacgcaattgagaaagttgagtttcaaatttaggattaattctagttagtttcgtggaacgcgaactgtgataattgccataattttacgcgagtgaaaaatgagtgtggctttatattctagtgattaattgacgctaggtgaacatttgaaaccatattgttttttgcgagtgtgtgcacagtacaaccaaagtttacctgataccgatctcagattagaaaagtagttaaactcatctagcaaaatgcatggcatgatgaaaataatttccaacgtcaaagacttctataatgaaataaacggtgctacgttaactggtgctattgatgtggtagttgttgagcagcccgatggaaatttcaactgctctcctttccacgtgagatttggaaagctaggagtccttcggagcaaagagaaagtggtcgacgtagaaataaatggggaacctcaagaaatacaaatgaaattgggagagagtggagaagccttttttgtagaggaagtagttgaagatgacgaaaacgaaattccagaacacttggccacttctcctatccccgtttcagagttcgaaaatatcttcaaaaatcagaggaggcgtctcagtttcgattttgaagacatatccaaattaaatctagaaaatcaacaaaatgattattctatacgtcgcaacacgacagaaaatgaaaataccaaaaccagagaacgaaattttatcaaaagacaaataggtctaggaaatatagatatcggagaaaattccgcagaagaaatgacgctctctatgatatctggaaaacacagtagcgaagatttaagcaggagccacaatgacatatcagagacaatttttaaaatggatagtttggatatggagagtagcaaagctgatgatccaaaatctgaaaccgtttcaacgcccacacctgtgaaatcaattgatgaactaccaagcgatagcaaaaatagcaacaaaaaaaggcggaaaagagtgaggcgaaaaaatgctcccagaaaatcaaccagcatcaatcaaatgcaaataagtcaaacttctgagaatttggaaaataatgaaactgttacggataaaagttctttggacagtacatcctcggatcaggatgttaagaatatgcaacaaaaagttaccaagactgaagatgaaaatactaggttgaacgattcctctaacctcaaaaaaattgacgcagattttcatttcttcagcgatacagaattgacatcaaacggtgttatcgattctaggtcagagaacccatctcatatagaaagtgttctgtccgattctgaattcgaatttaaaattcgaaaggaagaacctatggataacggtaagagctgggaatggggcgaatttccaagtgtttcgcagaataattctcctgccaatgacaacccaagagaagaacgcaggtcaatgttgagtggaatgttttcattcatgaaacaaaaacatggcacccaaactcagctaaaggggggcatgtacctgtcagatataacttcaggtcaaatcgatcaggaggtggcagaaatatactttaaccaaacgaaggagaagaaagatgtcgacatggattgtgaatcaggaaatggaccatcgttggcccaaagccccaacagtgcagaaggatgcaagagtgtcgattccgattttgaggaacagacgaaaattatccagtccggctgtcaagatatttctctatcgctatgtggttgggatcctgagccagattctaccaggtttttggaacacgtcgttaagttcagcgatttatgtaacactcctgtgttgtttgaaaatccgaatctggttgtaagaatcaaagacaaatactacaattggaaagtagcagctccaattatagctagttttatgatttatggaagaccgcttctgaagtcatctatcgatcagttgtgcaacatgcatatgcctgcggcattgacaagcaaagattttggtccgaaacaacaacaggaaacgaagtcttcctggtggagttggaggcgcggaaaaacttccagagaaactacacctgcgcccgagaagtctactgaatcagagaagactgtagaaaccaaagatgttactgatattgccgaagttgccgtagaagttgtagctggtacagaaaccacagtcagtgaaactgttggtaccaaggaagaaacaattttgcaacaatctacgaactcaaataatgaaaaacgtaagaagacattgaggttgagttcaaaacagatagcttcattaaatttgagagatggtgtgaacaaagtggaatttagcgttactacagcttatcagggaactacaaggtgtgagtgttacttgtacaagtggaaatgggatgacaaaattgttatttcggatatagatgggacaattacgaagtctgacgttctaggccatattttgccaattgttgggaaggattgggctcaaacaggagtagctcaactattcaacaaaatcaaagacaacggttacaaattattgtatttgagtgcccgagctatcggacaggctaggatcaccagagattatttgaaatcgatcaagcaaggagatttgactatgccagacggccccgttcttctgaatcccacttcgttaataactgcgttccacagagaggtcattgaaaggaagcctgagcagtttaaaatttcatgtatgtctgatattaaggcactatttccatccgattcaaatccattctatgcgggttatggaaacaggataaatgatgtttgggcgtatacagcagtaggaatacctattgttaggatatttacaatcaatccacagggagagttgaaacatgaactcacagagactttccaatccagctattcaaatatgagcataatagtggaccagttgtttccttcacgacttgatgctgctaatgactactctcaaaatatttattggcgggaccctattttacctgttgaagatttactagattaaagtacctattgttactatatgacctcatatcattgtcaagcggctgtcagtatatagctacaagctactgctttcgatgttgatgaaaacgtactattgttaaaaagtgtagcgctttatttttgtagggtttgtcgttttgtgatatataatggctattaagtttcattatttttttttatttattattgaagcatatcttccaaactatgaaaatttgttgattagaaaaaaagtagcaacttgaatgaaggattctgaaaaaactgttccaacatttagtgaagacagctaaattactacaaaaatacagttttttaatatttttcagaagtctttttcaaaatactttttcaaataggtaaatagtactacttgatttatttatagaaggttgctaatgattataaacctaaaatcttcaattgtcacttataaaatgacaaatgttttcaatttatttgaaaaactgtaagaaaattgtgatttttttgttggcattgtgataattgatgtacctcctgaggtagataaaactaaatttttaaatgtgatataattgttctgtgtttatagaggaaaagttttgtttatttttgtggaagtaatttttgaaataaagcatttattctttgcatcattccga

SEQ ID NO: 58 - DNA, 1370 bp, Leptinotarsa decemlineata
  Annotation=ARMET-like protein; Tribolium gene name from OrthoDB database=TC015785; Blast E-value Tribolium Gene vs. Leptinotarsa Unigene=1E-73
gacagatcccatatatattttttcgagaaacaattaataaccatagatttctattccctgttcgatttgtcaacgtggaaaattgtgctggttttatcgtttgaaattattaattttgatacttttagtattaggcaccaaagaactgagacaaaatggaattgcagttgcttttagcagtatttttagcctctgtggttgctgtaaatagtttaaaaccaggagaatgcgaagtgtgtataaagacattagacaaattcgcagccacattatcaggggatgtgaaaaaagaccccaaaaaaattgaaactgagttcagaaagttctgcaaggggtctaaaaataaagaaaatagattctgttactatttgggcggcctagaggagagtgcgacgggcatcctaggggaaatgtcaaaacccatgtcatggtcgatgccctccgacaaaatctgcgagaagctcaagaaaaaagatgctcaaatctgcgagctccgcttcgacgttgaaatcgacttgaagacggtcgacctcaagaaactcaaggtcagggatctcaagaaaatcctcaatgactggggcgaggagtgcgcagggtgtatcgaaaaaagcgaatacctcaagcggatcgaagaactgaaacctaagcatacagaattgtagatagtgattagagagataattttttgattagctttccatatggtcccaaaagtcgtctctaggtaatttctttttgtttgttaaagagactgtgggatttaggatctgtggaaagcaaagctaggactttatttggaatttagtgttgaggggttaatgcccttatgcaagtgagataccgtgtctgcaagaaaaaataatttttgagttgttaccttggtagcgctcgtgatatacattatctgaacttagtttaaaatatttatgtatgggaggaacaatatcatagtgaactatagggctattaattttttcaatttgattaataattttttgagaaaattagtccgttttttttgtagttgttgcttttatctgttgatgcccacagttccaaatgagtttcgttcaaaatagaattaactttgtgaatttacctcccacacaatattgcacgagttatttttataatgtgtatcacagctgtccgagaatcctttttttacctcaaaataatgttccaagagtgtttgattttttctgttgaataatcaggtttttaaaatggtcagtgcatgtttactagtttattttatgtaaggaattgtacaaaattatagacatttttgtcttattcacagtgaatcattttatttttgattatttattgaatatatttataacatatttgtaataaatacaaaagtt

SEQ ID NO: 59 - DNA, 2520 bp, Leptinotarsa decemlineata
  Annotation=Lysine 6-oxidase; Tribolium gene name from OrthoDB database=TC011653; Blast E-value Tribolium Gene vs. Leptinotarsa Unigene=0
aacatgatatttctttatttttatacactaaaataattcaatctcttatgggtcgcaaagaaatacagggatgataaaaaactggtgcaggcataaaacatcatagctttcgagaaaggaaactgtacagacaaggacaaaatgagtgtctcatgatatccgtggtgtggcatatttttcttctttaatttgagatattcagttggaagatcacaaaatcgcgacacgctaaacaaaaacatctttggatgtcacaatagtgtgacgctataaacaatagcgttgcaatacttgagacacccgaagatgctattgtatagcaaaacacgtatcgtggttttataaactttcaaatggaaacctcacatcaaagtgtgtatacaactaggtacaaaaattatagagaataactgatgaatgatattaataggcatgatgagtgaacaagagtgttttgaggaggcttcataatgatttaaagagaaatttcgtttggagcttgcatagactctgcatacgagaaatgttctcagcaaatacgtacatcagaaaaatgtttgtggaatatctagtgcagtttgtaccattcatcgaagaatggtgcatggctatgtgaatactcaaatcattttgaaaaaagaagcatggtttggcctcaaaaaatcccacacatgaatccaatggagcatttatgaaatgcacttcaaagattcactgctctaggctccttttgaggacaggaacataataaggcacttcaagttacgtgtcatattgccaaaggattattgtatagaatgtacaaaaaattcaatcagtagaagtattatcttgaaagttatgatgttttgaaatgtaacaaaattttggttgcactggttttttgacaatgagagtagcagaaatggtatcaaaaatatggtcttgtagataatgatagctatgaatggtgcttcagttccgttgatggtcattcaatgaaacccaagtaatactaactcacaatactaaaaaaaatctcttcattattcctcaagggcgctgaacaacgcagttcgtgacagttccatacgtctcggagtacaaaaagtcgcaaacagcggcattattctcgaaagacatctccggcaccttgaactccggattaacagccaccttcatggtatacttgcctggctcaaggtccgtaatgtctacccattgacagtcaacggtgtatttgtatatatctgaacagttcacagatattccctgatcaccgtagttgacgcaagcgaatacaggtttaacgccaggaaggcactggttgtcttctagacagaaggaggctttgtggccctctgccactctctggcctttgttgttgaaaatgtcgaaagtggcgaaaacttccatgctatgatagtgcatgtgacacatatgccactcccaaagatgcttcgggatagccggcctgaagtcggcggtacccgcgttgaaaatcttcgccgtgaacctgagcaacctcctggtttccagatgccacgccgggttctccttctggatttcgtaagccgtcgaagcgacgcagttctcctccatggcgcactgcaggaagaacatctgcttgtcgtccaagtgtgctgaagacatcagttccatgtggtcgatgatgagatcagccatcgaatgggtacaggaaactgcagcgacatctttactagcgcagtgccctgtagcgtgctgatcgtgtctacagtgggaaagggagctttcggtgccgaggcacttgacgcctcccaggctgtttttggttaggttgccaccgaagtagtccgtttgcattgcgtcgctggcgtaccccatgtttaaagatttacaaacaaccagagcttcgaaaagtgaccacccatctccacaaataacttcccaattgtctccagtttttatttccactcttccctctgttttaattcttccatttcgcagacgaatctttaggttttctggcagggacaccatttttggtttcaaaacttccaaactggttactttcgcttcttcttcaggttcatcacaaataaccccggcagattcggtggaagtgcaatcattttgtccccaaccatcgaatcggcactgagaaatttcttcttcggtaccgtcgcaatagatattatccatccaaaatcgtctcttagcgggaccaaaatatgaatttgccgttggttgggctttttctgggggatacccaagttgcttacaaataattctcgcttcagtaacatcccattcatcatcacatattgctccccaacttccatcatggagtatttccacattaccttcaaattctcctctgcctccaaccaatttaatacctccatctaccttctttagtcgtttcaaatgctttttgataagctgggcccttttcctctttatctcctcgggactgtcgcaaacaacgcataaagcaaaaacaagcaataaaactagcttcgaaatatttctgcttgttgacatcttggctaaattatc

SEQ ID NO: 60 - DNA, 1079 bp, Leptinotarsa decemlineata
  Annotation=Vacuolar proton pump subunit E; Tribolium gene name from OrthoDB database=TC0103671E-1; Blast E-value Tribolium Gene vs. Leptinotarsa Unigene=0; Blast E-value Tribolium Gene vs. Leptinotarsa Unigene=0
gggtgaagtgtgacagtctgactgaaaagtcacaagacttaacagaagtaagtcatatgatcaatcaaataagctttgcgtttcacgtccgtaatttgggtgtctcttgttaagtgaaggcgttgtctgtatcttcattaacttatatctcttgatagtatttcttgaaaaagttcaccatggctttgagcgacgttgatgtacaaaagcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcacagaaaaacaaaatcaagatcagcaatactatggaggctcgtctggagctgatttcgcagcagttggtgccacaaatccgtacggctctgtttggacgtaacgtcaacaggaaattcaccgattaggcatttatttggtggtcagttttgcatgttgtattctgcaattcgctgtaattgaaacactatagtgtttcggaaagttttagctgaattatgttcattaggatatcgtggttactggaacattaatctgtatataacatattccttgttaatagtatttttttgttttattcaaaataaagaagattgtccaaaaaaaaaaaaaaaaaaaaaagtact

SEQ ID NO: 61 - DNA, 4047 bp, Leptinotarsa decemlineata
  Annotation=Myc proto-oncogene protein; Tribolium gene name from OrthoDB database=TC000123; Blast E-value Tribolium Gene vs. Leptinotarsa Unigene=4E-41
cagcaagatcaacatcaagtccaatcacctcctcatcctcgtcctcctcatcatcgtcgtcctcttcatcctcttcctcttcatcctcgtcctcctcgtcttcttttttctgcgggccgctacatacaccgtgtgtcaggaaaaaacttttgtcgagttaaagttggcgttccagtgcttctttttgatatacctcaacgctctaagcagctgctgtgacacagcgtcagtcttcagccgggtcaatttgtgatattagaattagtgatactagtgactgtagcttaaaatagttaatacgacggaaaacgtaatagcaacatcgaggatgcatttgatcgattctttttccaaccccgtaaccgagccgctgctccccgacgacatatggcaaaagttcgagcttgatttctcgcaactgcccggattcagcgacaccactgtgatgcctcccgaagaacactcctacttccccatactagacgaagtgtgggccggcaaccacgactgcatgtgggccggccactgcggcagccaagaacactccaacgacgagttcaggcacgtgagccggttgatccccacacctggcaccagtttgatgcacccgccgccagtgccgacgatcaagcgagagtggcgagggtcatcctgtcagcagcagagcctgctcaagccggcggtgcgcgccaccgcccccatgctccacacgcctccgatgtctgacgacgaggaggccaaacactcgaaaccgacgagcgtcttgaagctgttgcgcgacgcaatcgacgactgcgatttggacgaagaggttgacctctgcaactacctcgaaggcaaaggggacgctgatatggggcccatgtgcaccgttaaggaagaggaggaggacgaggatgaagaggaagaggatgaagaggacgacgatgatgaggaggacgaggatgaggaggtgattgtcgacatcaggccggagctcagcaagatcaacatcaagtccaatcaggctgcagctgaaagcgatcacagctaccacaaaggaggacagaattccgcaatgcggttggcggagtttggcatagatacgccatctgattcggaagaagaaatcgatgtcgtctcggtggtggacaagatgcagttccagaacaaagtattctcgctgccgaacaacccgaccaccatagacaggcaacacatccagcgaagaatggccaccgccatatcgagaagaagcgccgcgacgcaaggcatcaagaccatcctaccgatgaggaagcctgtgagaaaacccgtagaaacgacgccgccgaccaagaggagagccgcggccgaaccgctgccgagaggggccaaaaggtccagacagtacagaacgacgacagtcaactcgacgccttacaaacgacgcgcttacggacacagcagcgacagcgatcaggagccttccgaaaagcggaacctccacaacaatatggagcgccaaaggaggatcgatttgcgcaacgccttcgaagatctgagagtcctcgtgcctgaggtgagcaagaaggagagggctgctaaagtggtgatcctgagggaagcggctcagtattgcgataacttgaccaccatttcgaataacctccacagaacttccgaggagctgaacaggaagcaggcgtggctcaggtggcgcgtctccgaactgaggaggaatttggcagcgaaacgatgagtagtttgaatttttgctgacgaaaatatccacgggaatttaacactgtgattgaattattctgtttcatataagatttagaatgaacgttcattttatttgttaatattgtataggtttttcgaaaagattacgttttttcttttgttaaaggacaaatactttttaatgttttaacgtgatttggtgatgaaaacaatgtgataaacggcgaaagtttttattatccattcgattggtttttgttttgttttttccgaaaattgaggatcgttttatttttaagctgcccaaaacattgcgaagtatttgccaaggagcaataataatataggttttcttttagtatgttttatagtagtttactttgtatattgtacattttctgttttatttttaaacggtagtttcatacataactgtgttttaacacgtggtttgtgaaatttattatttcgtcagaaatctatctgaccctttcgttcggttcgaacaacacggattgttcgaagagaagagatacattgcccaggagggtttgtcgttataaatccagcaagagctggagatgtttgggaggcgggaagacgccaccaaaaaaattattcagccgaatatttttcgagtaattcaccaccaaattaaaaggtgggagtaaaaaattgactgcgatcagagagcatcgattacaatgcattttaagctttattaatacttgtgttatgcgagttatatactattattattgaggggtcaaaacattttacttttctgtattttaagtgcttttactgttaggattttaaatattgttgagtttacacgagagaaataatatttggtgtgatttttgttgttgcatcgcgttaagtttttggtccttacgcgagcgaagccatctgattgtctcccgtgtcttggaatagaattatacgacaatatttaatcttcctcaagaatgttttcgtgtacattgtcgggacggttttttcgtctacatgtttaccgattgtgatgtataatatttggtttatcaaactgaagagaccgcgcttggatccgtctgtgttgagatggtcagatggcccgccggggtcccagcacattgattgtggatccgttctttttggcttgccgaatcaggaacggtggattttgaaatgctcaatgtgtttatatattttgttattaaaatagtggtgtttttttagttttagcatgtttactacttataaatactgggaaatatgtctgtgcatgaactatttgtataattttgtcttcctctgcacaggcattttgttgaatataatatgataagacgattaagtcgtgagatggagagaattgttgtgttcataatattttacagtattttatacttttgataaaataagaataaacccaaaaaaactagaaaaaattacctgaaaaaaaaacaaaaaacgatctgtcctcgaatcggcgaactgccggtaaatatgggcctacagttttcctttttttgcacgactaataaaaattaaggccgatcttcctattcaaaagtttgtctgtcgtaactcttttcactgccagattaacaaaaattttcatttttgttacggccacgtctgttgaactaaaatcgaaaggaaccttaattttttttgttcgtgcgagaactggataaattctcagctataaaacgtacctgtgatgtaacctcgctgtcgaccaaatatatagaaataatgtaatagtgagcatgacgcacatttgatttcaacactgacttcttttcgtcctagaaaatatataacagggcaattctctaagcttagcgaccaccgagcgatgcctctcactatatttcgagtggtgttgccgataagcaaaacatagaaagtatatttcagccctaaggatgttgtatggcaagatatctttgagccgatgtgagcctacagggtgagagcggaaaagcgaagattattcgaaagaaatgttggagtttaccaaaaattctcgggttttattgaggcgcttcatgagttttcaacatttttctccttcattgaaatctggaagagttcgaaaaatctttcgatatgtgaaaatccaaaccatcgttaggattaccgcgtcaccctgtacgtgtaaatataatataacgttatgagacgtgtaatcattgtttttattaataatattataatatgccataatatccttcctaattgattgttagtacttatttcacattcattattttcaaatgtttctttggtaaaatttataaggatttcagtttggtttttggttcctcataagttttacaaaataaa

SEQ ID NO: 62 - DNA, 4675 bp, Leptinotarsa decemlineata
  Annotation=Zinc finger protein; Tribolium gene name from OrthoDB database=TC006644; Blast E-value Tribolium Gene vs. Leptinotarsa Unigene=4E-94
agaaaacggtgccattacagatattatatagaatattttgaaacttcaaactactttaaatgaatacattagtgcagtatgtataacaggggtccagatcgatagataactttaatttctgtcaatggtaatgaaatgtagaacattgcaaggaagcattcatcaagaaattatgtatctaataaaaactttatgatcggtttgagttccttgttatatctaatctggtccaacaggtacgaacctgtgattgcaattagttcgaactaatagcaatcgcctgccagaagccacattattttgacagggaattgatggacccaacagcacgattataaatagtgtaaagtctaaaaggctgcgacctttaatcacctgtattaattttatattacaagatcaattattgggcattgtttctataacatttcaataagactaagatattcagtagacacaatttcatataaagaagtcctcaaaatatatcgtagagaaacgagaatatcttgcaacataaaattatacagggggttcatcaatccaacagcttcaaagctgtgactgttaatcacctgtctccctacgagtctctatataatcataagttagcatataatgcccaaaataactgcaatataatttcacagaatttgttcacggttctcgtttcacgaaatttcttttgaccttgttcaaatttttgcagttattgaagcaatagaagaataacaagtccactgaatgcaaaactctgacagtagatgataaaacatacttttcttagctgtcattatcccatcattcaaagcaaacaactctgcagttgacatttttgaattttcccaaacaaattttttttttttttaagcaaatacaaagttcaacatttagtgggcttatataatgtacacattatggaaagttaccaatgaaaaattgtgctggaaaatattacgtactaaacatgatgttttttccaaatatagtataatttttctatagaactaacacacctgaagaagctattatttagcgaaacacgtgttgtgtttttgttaaactgtttagaaaaaagctcacaataaagtgttttttgaatatgttatggattttcatcaagtttgccaactaagaggttgcaatacaaccaatgctgaagatgccgtcgtaattatgggcgaaattttaggagcctttgggccattgctacccaacccggataaccggttcccattttacttccagccgtgaaaacttgaaactttagttggaaattatatgcccagatctcgagcatgggtaagtatttttcttagaagagtgttaagacagtaatattggtatatcatgaaacttatatgtttcattcgtcaaaacagtgttcctcagcaatgcaaacttttgattgaaaacacttcaactgaactgctgacattgagaaaaaaatcttggatatttcaaagttcacgtttatttaagatcttttatgttccggaaactttccatattgcataaatatatattctattcaggtggatagatgaaatgtataacccattcccttcagcttattacaaataatcactgtacctttttaattgtctcattgggcagaccaaataaagctctacttggaaaatttattgacctaccttttcgttttcccaatgcattttggtgattacacaaaatcaatccacgacttctaacgatttaaattgttattctagaggagaaaatatacaataatatggaaaacgatgagcttaccttcatatcaaatgaagtgacacaaaaaaagcaacacggacaatgattgcagtactgggtataaacaaatgtcaagattcataaaaaatatgagaaaaatgaaaaagtttaatcttataattacagtagatgtatgaattgcacgcaaaaacagccccagtctcaaaagtgcaaaataaaattgaaaacaaaaaaaggttatcataaaatatcaaacatggagaaaaatccaaaacaagaactactcccaaatagaagaactgccaaactcctctcaacgcccgttttatcaaccaactcagcgtcttcaagagatatgaagtagactaattctagactcaaacctaaacgcaataagcctttgaggctacgacttcttccggagactgaaaagaaagaaaggctcccaagaaattgaaaaaacctctgaacctggccttcatttatatctcacagggtacactttcattttcacatatacatatattcacatcaatgatttcgggtcgagaacgaaaaaaaatttcctaatgaaagtttccgcaattttttaacgaagtgattcatttacatttatgaaatctctctgagcaattcatttatacgactcactctattaataaggaacttttacgaggaaatttccctccctgaaatcattgacgtgtctctaaaagtctggtttagaggccagagttaggattaagcctacttcatctcctgataccaccaaattggttggtaaaactcacgtcgagaagagtgttgcagcactaatgtttgggagcagttcttgttttggatttattctacgtcagagtttttagttctacctttcattaaataggaaagttaattctatgcaaatgcaatgttcaaaaatacaggaaaataaaaagaaacaatatttacatccaagcaattatcatatctagttttgaaacgatttataatggcactaattttttgttgaacaaatgaattatacttctctctcacacatttaaaatgcagttcaaaattaaatttctcatttcgattttttcacaaggcgtatcacgaatgaaccgtttgaaatgaatttgtttttcaaattttcctgcctcaaaatcgcaggttaacaagacagaagatttatgaattctctctcaacatttttttatcccagaagatcataacttccctgcaaatagtggcatggaaaccaacatttttcgtgctagaataataatgaaacaaaccttgtcttcattcagaaggtacacgtcaatgattactttaaaatgaaaaaaatttacataccatttcatcaggtaatacaattagtactttttgaaacctgttaaaaaaattaaatacaattattaatgaatcagtgaacatattgattgataacacggataaattttatttgacttgataaaagctactctttagtctacacccttcctgggaaaaatcggataaaatgtgttttactcagttttaaaaagtgaaatcattcttagacctgtggatgatacaaaaagtaaattggagatcatctaaaacgatgctgcatgataactggtcctgctggaaacataggagcactatacatcatacttggtggcattccgatcatacctggaggcatcgacataggaggcctcattagaggtcctccgatgagcgtggggtggcccggtatcatctgatgccgcattggagccattataggtccgcccattgtcattccaattggtgggcctgttaccctaactggaaatctctgcatcatggcagcatgatggttcattgcctccacctgcttttgttgatgagctactgcttgctgagctgcagaaactgcgattgccaattctgaagcagcagtacttgaatttgatgatccatcatctgattttgaaggaatgttcctagaatatttaacatttcttgctttcatttcttctagggagatatcttctgaggggtgtacgattttactggtggcactggaagtgttgattgtacctactttgttgccatcactgttgatattactagtactacctgctgcattactagtcggaggagcacttatggtagcagctgatgttattggtttgaaatcagcaccgactacgggggtaccacgtcccccaggggatgtactaggaatggcactgggaaaaagtggtttgtgaggacctccttgtccatgaagcattgcttgcatatgacctgccatcattggcatcccagggtgatgcaaaaaatgtgatcctactggtcccatagacatcattggtcccatttgcattccaggaggtcccatcattcctgtaatcattccaggcattccttgcacaagtccaggtgaacttcccagtagtccttcaggttttgaccgttttaacgcaggctcatcatcttcagaaccagaatcgtttctacttccttgtttttgtcgttcatgttctcttaaatcagccgcaggtattccctccattccatatatttcaatgtcaacattggaccgattaggcaaggagttaggaaccttatctatcgtttccttatgcacttgcatgcaatgtatggacaacccaggacctgtgtacaattttttatgacaaatgtgacatttgaaatgtttagccttttgatgttgaattaagatcttctcatcttcgaattccctgttacaataccaacaccatggtttagataacttcttctttttcctgcccatttttcaaaaataaacaattccttcacaacctcgaccgatccaacaccattaatagatcaataccttgaagggtgaaataattcatgtaacattagaggaatatacaaacaagaaacacataaaaatgtaagattaagatttcgatcaaaaatggtgacgcatgaa

SEQ ID NO: 63 - DNA, 829 bp, Leptinotarsa decemlineata
  Annotation=Putative uncharacterized protein; Tribolium gene name from OrthoDB database=TC015595; Blast E-value Tribolium Gene vs. Leptinotarsa Unigene=6E-78
ggtcacacccgatcagctctttagaactttgaaatccacatttttataaaacaatgaaacgtttcgtggttctcgctgttgttctggctgtggccttcgctgaagacaagaagcctgatgatgcaagcgaagtcaaaacgtacaggagacttattcccgcagatgtgctcagagatttccctggagcatgctttgcctcaacaagatgcgcaactgtagaacctggtaaaacttgggaactccaaccattctgtggtcgctccacctgcgtgttgtccgaagacaaagtaccacgtctgttggaactcgtcgaagactgtggtcctctcccattggccaaccccaaatgccaattggacgaagagaaaaccaacaaaactgcaccattcccaggctgttgccctatcttcaaatgtgaggatggagccaaattggaatatcctgaaatccccacagtagccccaataccagaagatgctcctagcacccctaaggcttgaaaactgaagtcactgaagtaattctcagctttagtttcattttcaactttttctccaatctatttctgattgtttcatttcacaaaaaaagtacagtagaaaaataaaaaaatatttattatttcttttgtttttacagtgttttcttcaatctctactttttaattatctcttgttcttttctgtacctttcttttctcttctgaaaaatattatcaaatcaaattgatctgaaacatatttgatttaggaataattgtgatatgcagcacattattttcatgttggaatttttggccagattatccgctgaatagtttttgcattac

SEQ ID NO: 64 - DNA, 2342 bp, Leptinotarsa decemlineata
  Annotation=JmjC domain-containing protein 5; Tribolium gene name from OrthoDB database=TC000138; Blast E-value Tribolium Gene vs. Leptinotarsa Unigene=1E-135
tcttattggtgagccggttgactcattttgatctttggaatgtgcactaagtgatattctataaataggttgaagccacatcagagcattgaaatatataaatacatatagtccctatcacattgacattagaaaaatgagcttacagtggacactcattgctggattcctgtatttggaaatagctgtggtacttttattagtactaccaatagcaagtgcaagaagatggaactcatttttcaagtcaaagtttttacaagttctacagagacaagctggcttttacttcttgatacttttggcgatattagttttgttccttcttgatgctatcagagaaatgaggaaatactctaatttggctgaagctgatgaacatggacatgcacatcttgatcgagaaatgcaaggcagcatgagattattccgagcccaacgtaatttttacatttccggatttgccctgttcctgtcattggtgataagacgcctagtcattctgatttccaaccaggccactcttgaggctcagtctgaggcatcaatgagacaggctcagagtgccacaacagctgccaagtccttacttgcacaacgtggagaagtcgctcaaaatgacagtaatgaggctcatgataaagaagtaatagagctgaaggccaagcttgtcaaagtccaagacgaactaaaacttgaaaagaaagataagaatgccctcaaagagcaagctgataacttggcaaaggagtatgatcgccttgcagaagaacacagcaagcttcagaaaaaattaactgtgggatctggtgataagaaagatgagtaagattattgtaacgatggatttcaaatttcggtatgttctctatcaaagtttaaatgttaataaaagaggctgtttgaaataaggacaaaatatattaattcgaaatatgagacactaggtgtgggaatatttaaatagattgatagctgagaaattatttttgtttagttcggtggtgaaatgaatatctttactgttctacaagaaaacacaattttttatattacacatatatttcgtgttaagaaacaatatcattaggcaatacaatgttatgaaaatattaatttattaacacataatttttttaagctacttatataatatctagcattgccttattataatttcgtttttttgttgaacttgttatgttatgttgaacaaattatgtctgtaattcctgctttgtaaaaaataaattattttccaaataaaaaatatttgaaataactcctattacttccaccaaaaactgactgaaaaactcttttccaatgcggaaacatgatgccaccattttacaggtataaataacatttcccctggtcctagcaaacatttgtacatttttgcctttgaaaattttgggtacttctctaaatctggttgcaagggattcacttgtgctgtgttgttgagcaacttatcttcatgagggtacaagaatggagaatccttgggggaaaataaaataatttgtttatatccatatatctgtgcaagaatgttattttttggatcatgatgcaatggagatactgtgcccattggccctagccatgcattgatatcgggttcttcagagttttcataatccaaactcaaacagcaatattctggtattaaaatatcctccttgagttcagttatctgttcaaataagttatgttgtgctaaatacccaattttgtagttatcagataaatagtgttgcttgataaattctttcattgtcatcagtttttgagaccagttctcatctacataatgagatccaacttctattggaactgtacggtctccagctattttcaataaatagtttacatctatccacttgcttgttgctggccaatgattcatgcaacctttcaatttcacaggtacttggggtagaaaatatgttttgttaaagtattccaaagaaggacactcctcagatggaaccatcatgcctagaatattttcactgttattcttttgataatcttccaattttctcttagttacttccacataacgttcatctttttcttcaatggctaattcgttaatcttcttcattaagtacttcgccaaatttgtcaagagctcagaatttttttccaagggagcgccaagcaaaattcccatatccaaagatttcaaacattcttttaggactgtttcagttagactatcagcatttttcaaaataattatacattttaaaaacttgctaaactaaaataatggcgtatgtacaaagccacctcgctccaatgtcctgtattcagttcatcatgtaaaa

SEQ ID NO: 65 - DNA, 1917 bp, Leptinotarsa decemlineata
  Annotation=Lysosome-associated membrane glycoprotein 1; Tribolium gene name from OrthoDB database=TC013767; Blast E- value Tribolium Gene vs. Leptinotarsa Unigene=4E-36
ggtatttgtgttgtttttccaagattaaaataaagaaagaagtgttcaatcacagagtagtaaagttcattgttagatgattaattagtttaacaatatgactatgagatttcaatttttcattatattcttgacatttttggctgttacctatgaaaatacggaagcagcacatagtcaggatggagcagctacgccaataaccccaacattagaatttgccgtttcatccaatccaaaaattcaaccacaaccacaacctactataaaaccaacaacaactacttctactactcccccgactactacttctactactaccccgactactacttctactactaccccgactactacttctacttcaaagccgacgccttctcctactccagctcctgtaccagatcccgttagtggagactggtcagtacaatataaggactctaataggagttgcatcgtgattgacatggctgtacagtttgaaattttaaaagtaaatcaaactgctactaagttgaatttaccgaaaaatgcaactgctaatggaacttgtgaaaacgagaagaacagtgtgtcgctgaattggaatggggacaaaaatgttttggagtttgagttcgtgaaatctaataccagtaaattcatattggatgttatttctgtcaaatttatcaatttgacgattcctggtcaagatcctaaaacctaccagctgatacacaagcagaacgaattttcaactcctctaggtaattcttacaaatgttccagagttcaaacattgaatctcactgaggagaattcaaatgaaacagttgcttacatacacttgtctcaagttcagttcgaagccttttctaatactactggacatgtatttgcaacagccgtggattgtgatacgtctctaacaaccgatgtagtaccaattgtagtaggttgcgtactagcagctctagttgtgatggtactaattgcctatctcattggaagaagacgatgtcaagcacgtggctatctctcaatgtgatctgatgaaacttcgcttacgaagtttcccaatagagagctactggtggttgctctcgcatattattgtagattatttggactagcttattttatataaagtcgacgttctagagttatatattgccgagttttctttaaactgatgttgaataaatatatttttgaagtataatttttgctaatgtagagccggtggatccataataaacggtacatgaggacctcaactcatcatcaattattctggaggatgcgaacaaatttctttctttcatctaatgtagaagttttttttttgagtgtaagtaagctctaggacgtaatggcttttaataatagtgattagtattgatgtagtagttattatcgacagggctgaaaccgattatagttgaaacttcttataatgtttttaccatgacttttttttgtgaggaatcttaaaaatacctgtcgaatcattatattgcaatattggtatttcttttaatttttttgtggttaatgattagtacagtttttataaaggaaacccaattttatttcattattggtctcaaaattctaatctgtctatactttttttccattattgatgaagaatcgatgtgtagttacgcagggtactagaaaattttgaatgaaccagtaaaaccttgaattttggaacaagtggctgtgagcttatattagattcctacgataaattgtaagttgctttttcaaaatatttttctgaatgttggaaagtaatgagtgatttttcttatctatattacttggtgaatttgtgctttaatgaatagcgacagtttttagaatcgaatgaaaaattgtactgtattttgttattactgggaataataaatagtctttaggttt

SEQ ID NO: 66 - DNA, 1962 bp, Leptinotarsa decemlineata
  Annotation=GPI transamidase component PIG-T; Tribolium gene name from OrthoDB database=TC013150; Blast E-value Tribolium Gene vs. Leptinotarsa Unigene=0
gggattcaaattttctaaataattgaatttgttgatatggagtgtattgatatttgaggagtctttaatctaaaaattacattataattgataaaatgaatccaatatatttagcagtgcttgtattatcccatttaacatttgtattaacctacaaagatagttttacagaggaactgcttttgaaacctctctacagtgaacaagtatatgcacatttccagttctctaacaagtgggacattgattcggaaacagaaacattcaaccatagtcgattattcccaagatccttaggagagataatcgaacgatttaacgtacaagaacttcacgtgagccttaccggaggcctgtggagatatgaaaactggggttatcctgttacagatgcagcacccggcgcagaggtatgggcttggttctatccaagtacaaaagatgtcaacaaaaactggaaacttttagcaaattccctttccggtttgctctgtgcgtccctcaatttcattgacacatcaaatagtatcagcccggagtattccttcaggcccagaggtgtcactgattcgcccagtgtcaacaatacgttcttaaggtatgctagtttgcctcgcgaaatcgtctgcacagaaaacctcaccccctggaagaaactcttaccgtgcgactccaaatccgggcttgcctctttgttgaactctggatacatacacaatactcgataccactccattgggttgcacctgaggagggtttgcagggacgactcttgccaagccttgtcattggacttgcagcagaccgtatcattggtgtatgattacggtattttaggcaccaaggactggtccctttccaagctattcggacaaggagtaaacggaaactgtgtgttggcagagagaagcgaagtttacgtggacatgacgagtgcggaggcccaaagttttgaattagaaccacaaccgcaggaggtgatgaaatctacgagaggaggttacgaatctacattcggcaagtatatcatccccaataggttcttcaacttgtacgccaaatacccggaaaaagacgttatatccctaaattccccaccccctttgcacgccagccagtatctaacgggatacggtcaggaaaggggaggtatcgtagtgaaggtttacaacaatcactggaataacttggacgttgtgcttctgcagaacattccctggtacgtgcccgtttacttgcacaccctcaaggtagagtccaacgggagaattatcgagcctgttgcgcttaggtacgtccctggccggcagagggaacggccctactacctggaggtcttaatcaaattacccccgcgctccgtgacatccgtctccatagacttcgactacgtgttcctcaagtggcaggaataccctccagacgcgaatcacgggttttatatcgggtctgctgtggtttctagcatactaccgcttgctcgtaactacacgggactcccccaggaaggctctaagatctccgatagttttaatgcatcgcgtagcgggtactttgtgcaaattcgtaccgaaaatatggttgtgactttgccgactcctgacttcagcatgccgtacaatgttatttgcttggcttgcacagtggtagcgcttgcgtttgggcctctgcacaatatcacgactaggcggctggtgctgaagcccaagaagaaggaatcgctgctagtcaggttgaagaaatttttgacttcttttaagaagtaacgtgtttgatgtgtgggattttttttagtgtattgtgagttttttagaagcagagactcgccttgagatgcaagttgattgtaaacagaatttttcttcaattatcgaagtaatagaaaatatttgattatgtttttaacattatttcataatgatattcatcggatggacattttcttagctggttttgtattct

SEQ ID NO: 67 - DNA, 1952 bp, Leptinotarsa decemlineata
  Annotation=Viral IAP-associated factor homolog; Tribolium gene name from OrthoDB database=TC003566; Blast E-value Tribolium Gene vs. Leptinotarsa Unigene=7E-12; Blast E-value Tribolium Gene vs. Leptinotarsa Unigene=0
agtcaaaagtattttgtaggttctatttttcaattgtaggttaaattttagatagctaattttactccttaagtcttgggagacaaataccagtatttgataccagaattcgaagtgcgactaaagaaagctgttgaagatgcaggaccctaatgcagatactgaatggaacgatattctccgggccaagggtatcattccaccaaaggaaaaagaaattactgaggatcagattgtatctatgttagaagaaacaattgaaaaaaaaacatcgaccggaaaagatctatccgagttgaatttggatgagttggacgaattggaagattccgaggacgaggctgtactgttggaatatagaaacaaaaggatagctgagttgaaagctttagcagaacgtagaaaatttggaagtgttggagaaatatcagctcaagattatgtcaatgaggtgaataatgctggagaaggaatatgggtggttttacacttatataaacaggggattccactttgtgccttaataaacgaatacatgaaatatttggcagttaaatatcccacagtgaaatttcttaaatcaatttctactacgtgcatacccaattatcccgacaagaacttaccaacaatattcgtttattttgagggtgaattgaagaagcaattggctggacccttagaattccgaggaccaaatttaaaacaagacgaatttgaatacatcattggtaaaactggtgcaataaacacagacattaaagaggatccgagaccaaaaatcaaggataaaatgttcagtgatttggctgatactaatgattgggagtgataatggtttagatttgtggaaataatttccacgcatggctctgcttgaaaatatttaacataaatctctctggaaaatatttcctagaaactgttcagattatagatttgagtgaattgcaaggtgaggctgaattttatccactttcaaagtagattttgataagtgactcattgatgttgttgacatttataaagtgccgttcagatgcatccagtgttttagtcaagaaattttatacataaccaatctaagtaccagtagccattccctgacatactgcatcatgtgaacatttggttttgacgtaaccaaactcaataactatactcattatggctatttttttaattcaatttatttcttttctttttttttgagtgtgacggagtataggattcgtcaaaaacatataaacaggctttctacttctcgacctttttacaaaaatatgtggaaattttgggattaatttttcaacatatgaaatttcatataaaattcttttcatcgatttaatatatgaatgtgattgctcgtaatttggatctactataaaaatcaaaatatcgagtacaatggtactagaagtaggtacaaaatatcagttatttcattatcaacattatcaacaaatgaaatgctataataatgataataaatagctacaaatgaattaaaaagtgaaagcatttcttattgtgtagtgtactgtagtgtagattttcctttagaaaaatcatgctgtttgtaacaagatagtcaaatattttacggtgaagtactaatgcttctctgattcacttcttctgtcactcgtcttctcataaactactggatgtgtctgaattagtgatataacaaacacaactctatacctcaagatttgaaattgctctggtggcaatacatacttgcctaatcactgttttcaatccaagcatttgatttatattttttttttatattcatttcattgaaatttctggaatttaattatcttataacgtatgtttcatttgtatttcctaacaaatcacctacaagttattattagttcaatgatttattttaattatttatttattttggtagtgtgttgctgtcatttgcgtgttca

SEQ ID NO: 68 - DNA, 4455 bp, Leptinotarsa decemlineata
  Annotation=Putative uncharacterized protein; Tribolium gene name from OrthoDB database=TC002594; Blast E-value Tribolium Gene vs. Leptinotarsa Unigene=1E-57
tggcaccgcgtcgcgatgccagtgtcttgaacccccagtgcatgccaacaccccaaaatgttgtcatacatgctgcccatcgatgagaaaccgcctccggcgccgcccaaagcccaccttcagttgtccctgggttcggagcacgtcggaaactacagggcgtcgtcgacgcccatcagcaaggagacgagcgtcagcagctttgccagtgacgcaaccacagcgacggcaagtcacagttccatgaccccgacgagtaccagcgaaaaggggaagcccaagctgatgatcaacgggaagcacccgcctcttaaaagggtgtccttcggtagctccaaaggttccatggtggagacgctaatatttgagagtccagtacaagaggagagcgaacccagtccaatacctgagaattgtagcccgtttccattagatcacgaccaaactgaagccgaacgggaaaaagtccgcgtgacatttttccagcaatcgaaacctctcgaagtcgacctaccggatgaaccgattttcacagaaacggatttcatgatggcatctccagttatgatgaacgaaacgaatcacgtcatctacaacaggacggagagcgtggagagcggctgggacaatcccttccgacctggcggtgacctgagcagagaggcagacgaaatcgtggaactgataaagggcggcaagcccattacgcccactcccgatcaacaggcgcccctcctgccccctctggatgaaaacgatcactcagtcctgaacaacatccaggagcctatcacggaatctcccaagaagaccacccaactgaatgcagcaccgccacagcagaataatgccaacggtactgccaaaaacgaagccaacgccaagacgacggtctcgcccaaagcgacaaccgcccctgggagcgtggacgtgcaaagggtgactgtgaaacccgatggcgatacgtgccaagtggagcacgtaactatcaaaaaaaaacccaagtgcaagtgttgtgttatacaataactctggatagcgaatagaatttttgttactgttatatcttttgtagaggaggagatggagggagatcgggttgcgaaggccgagagttagcgtctgtgataaaaatttcagtagagtggaagatgtactgcgttccccccagtgaatcaaaaacatattgatatcaatatttatagttttgagttgtttcctaattacgataaatcgacattcactggccggtgccaagtaggtggatcattagtcaaccctgagggcaattggaaaactcccacattgaatgaatgcttcatttttccaaagaatgaatttcagatacttttacatatatcgaaatttcttcccatacattctcaaggtatctattttaacagatgggtcactcgttagcccaaaaggcagtcgtagaaattcctgggaagactaaatctatttttagtcggtgttcacttcacattacacacactgtgtacatcactctcatacaattagtgaacaaatcaggtcaataggctacctgtacatttttgctcgaatgtccatgaaactgactcaatgttacgagacatatccacttttacaattcggcttcaagaagtattcttgaactataatgaatattttcacagaaacggcagattacacaacttcaattttattcaatacacaataacaagcataattacaacactatccagcataataatattagtagtactacaccacaatcaagcataaacagatctgcacgtggcccatttcttcaatcacttgtcaggtagatggatcgcttgttagtcctaatggcattcgaaaaaactcccttgagctacgaaaatgtatatattttatatatttttaaccacctagttttttaaaatcaaaactgggtaggttatttgagatctgacaaccaactgtacaaaatttaaataaaataagaaaacatgttgaggctacaaatgtttttatcacagattctatcggctttgaagtgatactggaatttgatagaaacagcctggtctcatatctgatgtcaaataccattatgcttcattaacgcttgaaccaatctccaaactgttaggaagtggagtataacttcatgcactcaatacccagtacacctttaatattggttatatattagtggacagaggcatacagtttattggtgtgaagaagttattttggattacacaacaatcaaaacaatgtgagaatttaagtaaaggtacttcacaggttctggcacaaaatccgatgctttttttgtggtgcttcatttcagtcatttacgatccgttcaaggttattcgaactggtcggtggggaaggtcctcagccaatcaggatggagagagcaaatatcgacaaggtggttgcatcaaatgaaattgttcggggatgacggtgaggatgacgtcggcgggcttttagcagatcagatttaaacagatcttgattaggtttaaatcaggtttgaacaggtacttattcggtaaagtggccacttcatcagataaatacctgtttgaacaattatttatctggtaaggtggccacttcatcagataaatacctgttcaaagctgttcctgacctgatcgagacctgttcaaacctgaataaaacctgatcgagggatctgaccatctgatacaaccacctaaccattctgattggctgaggaccattttcgcctcgaatgaccttgaacggaccgtgaatgactgaaatgaagcaccataggaggggagcatgggattttgagttagaatttgttatgtagctttagcaataaaccccgtgcttcaattaagtagcataaatacgagtttggaatcaaactttgggtgtttatttgaagcacttgggtatgaggaatgtgtacctaaaaggtggctatgatttttcatcataaaatagtgagattttattttcctataagaatatagagtattcgagattattttttcattcagaagcaatgaatcatttgtatgcatgatgtatacagtctggtcattttattaaatttatttttcaatacttatcagatcgagtatattgccttaattttattactcatcgatttccacatatttttgttctgtttatattatttgttgatgaattgcttccagactgtattcaaatggatgtatatgccactgatttttgaatgaataggaagataataatcaagaaaatataaactaactatatatgtacagaatagcaattcctagttattgtatttacaactaacgtcaaaaactgtgaaaataaagagatctattaatagttactttgagattaaagtgtcagaatgtaggttcagagcatctgagcgttatgttgtttgatttttttcatttctcaaggttggtgacactgaaattcagtaataatcaacttaaatattagaaataagtttcctcctcagcggtttttatcacatgtgagttacatgatgtttgaaatatttgaaatcaaacaatttaatgcagaactttttataatcaaacagtttacatattttcagtttgaatacctacagtgagatatgagagatattcgaatcaattttacaaacatattttatatactttttgagtcatatatgatttttaaggcaattaacaatttttaccttctacctaacctacattttcaattttgattacatattttttccgggacagagtgtttgatggtttcaaatttgaagcttcattatttaaccaacaaattaacgtattttattgtctgaatcgctgtccctcaaagtgctatgagatgtagatattatatatagtacaattagttattttttataagctgtttcgatgagtggaaaagattcatcaagaacatgtttcttcggagtaacgtggtaacaagtagaacagttttagttatatgtttcgtatttttaagttttatttcaatgacctcgttgaattgtattctttgtgtggttgtatgaatggatcctactttcagttcattatcaaaattgttccagcacaaaaagcccctttcggttttgagataactcagttacacgggtgcacagagagtttgggagcgaacctaataaaatatacggagtgcgtcacgaataaaaacgatgttatctttagtttctcattatcctgtatgtgattatttgtatgtgaataacgtcctctgtatagttggtctgtgtataatataatgcagctttttatgcttatattacatattatgtagattatagaatgtacattttataagttaactatatctccccacaacttttgtaatgatttgatattgacttatcattcgttaattttatctcttctgtatcatattgtataaattaacctttatttgtataccatgccacattgcattaaaaattgtgatggtctc

SEQ ID NO: 69 - DNA, 2343 bp, Leptinotarsa decemlineata
  Annotation=Putative uncharacterized protein; Tribolium gene name from OrthoDB database=TC001918; Blast E-value Tribolium Gene vs. Leptinotarsa Unigene=2E-12
gcattgacaacctaaactatattctattatataaatataaagtttaccgtttatttatagaacaacctgtattttgcaatatggtataaattagtaggtattttaatttaacgattttttcattgataatttgttagattcatagatccatccggttttcgaatttatgacaaattttatagcatgctatggtcgtttgacagtttcaaagtgtgattcaccatacataataggtatatctgtaaaatattaagaatattttaaaaatgagtgattcaagcgattttgaagatataaataatacaccaccggatattttggaacaagttaatgtaacggtacaatctttattgccccaaaaatctaaagataaatacgaaaaacaatatttacatttcaagcgatgggccgaagaaaagcatattcgtatttactcagaaaatgttatgttgggatatttttcgatattagcaaatacactaaaagcctctacattgtggtccaagtattcgatgctacgtaccatgcttcaaataaaagaaatatggatattaaatacccaaaattaattgctttcttgaaaaggcaaaaccaaggatataaacctaataaggcaaaaaccttctcaagagaggaactaaataaatttttattagaagcccccgataataattatttattaatgaaggttctccttattttcggaatttcaggagcatgcaggtgtgacgagctccttaaaatggccactacagatattgaagataaaggttcaatattaatagtaaatataccaaattctaaaacaaatattcagagaacgtttgtaatcaatgcttcactggggaatggccctaattatattgatatttatagaaaatatatatcgttacgccctaaaatagatcagacacgtttatttgtctgctatagagcaggaaaatgtatcaaccaaatggttgggaaaaatactatagctaaaattcctacaaaaattgcagaatttttaaaactgcctaatgccataaattataccgggcatagtttcagaagaacctcggcaagtttacttgcaaattctggaggagacattcttactttaaagcaacacggaggttggaagtctacaaatatcgctgaaggatatgtgcagcaatctcttgcaaaaaagcaaaaaatttcgaacctaattatgggagtcactaaagttaatgaaactgattgtaatcagccaagtacgagtatttccgagggataccagctgtataataatatagttagtgaaaatatcacgaaaactgcgttggatccagctctcagttctggtggtattcaaataaccactgctcaaaactgcacgtttaacatcactataaataattactctagcagaaattaaaaatatgtaggatgcaagtatgaaaataccgtccctatgagttatactgtacctacttctcagttttagttctttaataaattttgtttgtaagtttcataaataaattattttttggtagtttcataaataaattatttaaaaatttgagggaggcggaaaaatcatatgtataacatgggggtaaagtgaattttcctcccttgaatgattacttcattctcgggaggaaaagtaacactttcctccattgttatacaaatagctatttattagctggatcatgctttttaatcttgaagtccaatatctttggtttacttagatatacttctaggtcaaaatcgaaacatggaattattttgtttttgtgaatatacttttcaaaattttcaacttcactatatgcgtcaatcagataaggttttttttatttttccaataatttaattttttctatcatatgtgttaaggtaataatcaagtacattaaatgggaatcctgatctattttattagttataaacttacatgctagccattttcttctataatctaaattcatctccccagtttctgccattaaggcattaattggagttgacttcatgcatcctgttataatcctcataccttgatttcgaatattattaaatttgttaaagtttttttgtgagttatgtataataaatatagacccataatctaaatgggatttaacaagcccaattaattccatttttaatattttaggatttgccccccaccaagttttacagaaacatttcaaaacatttaaccccttgctagctttgcttactatctcattggtatgtttattccacgttaaatttgatgtaaggttcatgccgaaatatttaatttctgaaacattatttaaattttcattccctattttttatatttgttgatttctgttgttg

SEQ ID NO: 70 - DNA, 2580 bp, Leptinotarsa decemlineata
  Annotation=Glycoprotein 93; Tribolium gene name from OrthoDB database=TC012185; Blast E-value Tribolium Gene vs. Leptinotarsa Unigene=0
gaatcgaagttgtcaagatctgcgagttgcgagttgtactgtaaacgtagtggaaaaatcttgaagtttaccggcttcgatagtcttttacatgcgtttgaaatcctaaaaataaagtagttgaaatgaagcagctattcttcttaattatttcattttttgtcctcataggatgtactactacaaaagctgaagatcttggagaaggaagtgttgaagaagttgaacttgatctaggagcaagccgagaaggatcaagaactgatgatgaagttgtcaaaagggaagaagaagcaatcaaattggatggcctcaacgtagcacagctccgagagcttagagaaaaatcggaaaagtttgctttccaaacggaagtaaacagaatgatgaaactcattattaattccctttatagaaataaagagatatttttgagggaattgatctcaaatgcctctgatgcactggataaaatacgaatgctttcacttactgacaaagaggttctcaattctcagcctgaaatgaacataagaataaaagcagataaagagtcaggaatgctacatataactgatactggcataggaatgacaaaggaagatctgataaacaatcttggtactatagcaaaatctggaaccgccgaatttctggctaaaatgcaaacctctgaaaccagtcaggatatgaatgatatgattggacagtttggtgttggattctactctgctttcttggttgccgatagagttactgtcacttctaaacataatgatgatgagcagtacatttgggaatctgattctgcaagttttagtattattgaagatccaagaggagactccctgaaaagaggtactactatcagcctagaactaaagccggaagctaaagacttcctagaacatgaaaccattcgtaatttggttaagaaatattcgcaatttatcaattttcctatctatttgtggaccagtcacactgaaacatctgaagaacctttagatgaagatgtcgaagacaagccagggccttctgatgaggaagatgcagcagttgaagaagaaaaggaagaagagaaaccaaagaccaagaaggtagaaaagaccgtttgggattgggaattgctcaatgacagcaaaccattgtggacaagaaaaccctctgaagtagatgataaggagtatgatgagttttacagggctctaactaaagacaccaaggaacctttgactaaaattcattttgttgcagaaggtgaagtcaccttcaaagcactattgtttgtccctacagttcagccttcagaaagtttcaataggtatggaacaaaaactgacaacattaagctatatgttcgtagagtattcattactgatgaattcaatgacatgatgccttcgtacctgaatttcattagaggaattgttgattcagacgatttacctttgaatgtttctcgtgaaactcttcaacagcacaaactgattaaggttatcaaaaagaaactagtaagaaaagttctggacatgctcaagaaactacctgaagaggaatatgagaagttctggaaagagttttccaccaacatcaagctgggaactattgaagatcctgctaatcgaactagactggctaaattgttgagattcatctcatctaccggaggtcagttgactggccttgcagagtatgtcagcagaatgaagccgaaacaagatactatattctacattgcgggggcttcaaaggaagaggtggagaagtcaccattcattgaaagattactccgtaaaggatatgaagtgctctatctaaccgaagctgttgatgaatatgccatttcagctattcctgaatttgaaggaaaaaaattccagaatgtggccaaagaaggtttcagtttatctgagattgagggagacaaggagaatttggagcaactgaagtctactttcgaacctctaaataaatggttgcatgatgatgctctgaaggaccagattgccaaagcagtagtttctgaaaggttgagcgaatctccatgtgctctagttgccagcagatatggatggactggtaacatggaaagattggccgtatccaacgcccaccaaaaatcagatgatccccaacgcacttactacttaagtcagaagaagacattagaaatcaatccgcgtcacccattgatgaaggagctgctcaaaagggtaaacgatgatcctagtgatcccattgcaaaaaatatggctaaggtgatgttccaaacagccaccttgagatctggatatatgctaagagaaactgcagattttgcacattccattgaaactatgatgaggaaatcgctgggtatacccatcaatgagcaggtggaggaggaggaagatattcctgaagatgggattccagaggaagagaatcttgatgcagatgcgaaagatgatgaacatgacgaattgtaattataaatttttttttgagtgtctgtgtgtatgtatgatggaattatatttgattgttttgtacaatcctgaaagactgtactcctaattttgtatttttgttttaata

SEQ ID NO: 71 - DNA, 2895 bp, Leptinotarsa decemlineata
  Annotation=CG2211; Tribolium gene name from OrthoDB database= TC003519; Blast E-value Tribolium Gene vs. Leptinotarsa Unigene= 1E-148
gaaagtagctaagctaaaacttaacctaaatatcgaattatattcaacaaaatatttgaattatgtatcacaatgtatatttctcaaagatgtaatctaaataatgatgacaggaaaattggaaaaaagaatatctctggaactgaaagaatctttactgaaagtcaataaacattatatgaatttgggatgtaatttagaagatttagagaaacaatgcaccttcaagggccttttcagtataagcaaaactaccttttttttaataccaatatttatgtcttttctgttatatgaattggactactttgttgttggtttcaactatctactaggagtaagatgcattgtccctaacaattattttatatgggaggctacacgtcccataacagactgtaatttctgttctaatacactcgaacctattatattatcaaatattactaaaaatgatttcctgccatatgcatacagctcgaagcctattgttataaaacgagcattcttacactggcctgccatacagatttttacccttgaatattttcaaaacttgtatagaaaaacagaagactcgttcaagagtgtagatgaggaatgtcagttcttacacttcaaatctgattttatgtcgttgagagatgttctatctatgagtaaggaaagatctaaaaatagcccatcagagaaatcctggtatgttggttggggaaattgccatccagttgttttggaaaaaatgagaaaacactaccctaaaccacattttttaccagatgactgcgaaatcccttcaaaagaatatgtattcatgggatacgatgatggtgctactatgcatctggacttcataaatcgtcttatgtggcaggcccaattgaagggatccaaggtttggaatctgcatccaccgccagaatgtgaaagcatttgtaaacctttctctttcatggtagaacctggagatgcagttcttgtggacactaggatttggtaccatgggaccacaattaatccaggagaattcagcctttctgtacaatcagaatatggataaacgaaacatttttgccccaacttatgccatctgagaccaaaatgttgccaaatattagtttaagtattgaaaatgttaccaatacaaagtagaaaattcatgattataaccaaatttatttttacaaatgattatttatcactatctcataaaataaattagctgatatgatgtaccagtgatgtcgcgataaatttaaaaaaatcagaatacaagtcaacagcaattgttacaaatctgtttctctagtctttctttctggaaaaatcattgaaattttagaatctgttaaggtgtggagtcaaaaactattattattggtttttcatctccatttgattactggaagaatgatgatttcgtgtagattattttattttcagctgtatgttcatagtgtccagcatatcatctaactcactttatgattatgaaaacattactattaatctgcttgtactcttactatttacagacaataataaaaaatgagtattttctagtctaggacaaggtttgaaataagctccttgaagtatacattcatgaacgtatgaactgcccgattgtcattttgcaaaatgtgtgcattcaactgtattcaccaatgttttcattgcctttttcactttcaacacagcatatgtcacgaaagacttactattttttctaaaagaattattagtattcaacttcagcgaagaaatgggcatcgtaaaacgataaattctcttcgaattctcgttggtacacctacttcccttctcgtgcaaactttttgagttgttttcaaagggagtagtaagaaagtttaaaaaaatcctacggaagtcatgataaaataatgtttaccaaacaacgtagccaatgacagcgttggcacagtatacttgtagcgttggtgtttgtgaacaagtgtgacgtcacccttttgtcacgtgatttgagagttgttcacttgaatttgatttatcaaatcaaaattaagttcccaatgataatgaaaaatatcgtgtttttttggatttctgttataaaattggggtaatattaaagtctcatttcaatgtagtcatcatctctatcacagatactccataaaatatatttgatagtatagtaactacttgatagtttttcaaagctaaacatatatttttttttactcttgaaactttttcgattgttgtcttgagtttgaaaattggaggtgtattataatacttaaaatctcaaaaaggtaccaatatctttcaatatatacaccaaattaataaatgaatgagtgctgaatatggtcggtttatttttcaactgtaagttgactatagtctaagtagtatcagtgttattgggaattattacatccagataactgctaagattggtgccctgtttctcggcattttatgaaaaaccgcatttgtaatttgatgatatagaagacttgaagatctatctgtatttttttgaaatattgcatttgatgatgacgaaagtcaataaacgccacacttttagaaatgtctttccaaatagttgcaacaacctgtttatgctgtgccatttttttattcctataatatattcatgagttggatgggtatcttcgcttattgtttctcatttaattgtaataggaactttcctaggctttatattatttattatatatttactaatttatagcttttttattagaacttttttttcaattcaagattatagttaccatcttttatttataaattaatgccattctgtgccattcaaacgttgttatgctttaaaatttcgcatttcattatgtctaataaatggttagaaaaatttag

SEQ ID NO: 72 - DNA, 1875 bp, Leptinotarsa decemlineata
  Annotation=Prcc protein; Tribolium gene name from OrthoDB database=TC002646; Blast E-value Tribolium Gene vs. Leptinotarsa Unigene=1E-1; Blast E-value Tribolium Gene vs. Leptinotarsa Unigene=0
gcttcaatctctttgaaaacaggattgatataaatctcttttattaatatacaaaaaaaggttttcacttataaaaaacgattaaagtatacattaaatcagtcaatccaaaatcatacttaaaaatactattagacgtttgaactaattctctgaatcattcattccaaaattaaatctaaaagtttccccatcaggacatgttgcactggaagttgatatcagctcatttgaagaaccatttttttcatctccaaagtttgattggattgtatttctcattatagatgtcaatgcacgttttttaacaaacactgatttactggggattgttgatttaacttgcttgactgccggcttcatcaaatcactttttaacattttcttttcttctgctgccattttctctctataatctccaaaactcaatcgcatcacctgtctttttttaaccatgggtgctgtgttactcataagagtattcaaagctttgctgtggtcttgtacatttgaaaattattattttaattaaaaaccatatttagcccttgtagccattttattatttctacttgcactccaggcattttgtagttcctgttcattagctttggcctgttgtaccaaatacgtaatatgatgtttctttcttcttgttgggtctacaggttcatcaatttctggcttaggagctaattctgggtcagttagtgacttaaccatccaaagatctttgtccagtaacatttcttcttcatttatatcaattagtttgatatttccaattggccttttagatttaccaaccaattctttgaatgccctattgtccagaccatcgtactgtttctcaggttctggagcaatgtctataacttggctggatgactcttctactggctctcttacaatttgtttaggttttggtctaccacaaactttttcccacagttcatcatcaaacgtttcaggcatttctatatcatcatcactttctacatcactgagtgctgttttttctctattttcctgtattttttctattcgggcagtttttcttggatttgctttcttcttgataacatcaggtacaagattatggctttgaacagaagtagatggagtagcattcttgtttttatttgctacaacatttggtacaaaacttttggcagtcatcacagttccttttacaggaggtaatagtgaaaggaggctgctgcctttcattgatttaaattttttggctggtttctcaccttcttcgtcagaaaactgagacagagatggaattgtaattttaacttttttctttcctttgtctacattgatagcttttggaataaaatcctcaatcgccccttcctggaaggttttgacagcatgtacttgtggcaaacttgaaaatatgccagttccattgtcaagcatactactcgatcctggttcatctatttgacggtctgtattactgctaacaataccattcaaatctggttcattttttggaagatctgaattattagaaatgttcattgttttcccatcatttgtaagggaagtaggagttgaaaggttgactccaatttcatttggggaatcttcatcctcactttcactattgcttccatagtcataagataccagagacattgctggctgatttatcttgtaacttgatcaatgaactttttttcttcaattcaaaataatgaaatgtacaataaacgtatactctactccaacgtatttaaaagaaaacctgatctatgcacatccaccacaaactatgctaaagtttaggaacaagaagaatttaatatttaataacaatgacgaatgacgttagacctagacacaatctacatggtcacc

SEQ ID NO: 73 - DNA, 4880 bp, Leptinotarsa decemlineata
  Annotation=TBC domain-containing protein kinase-like protein; Tribolium gene name from OrthoDB database=TC000615; Blast E- value Tribolium Gene vs. Leptinotarsa Unigene=0
tacagtgacaatatatttgtaaaccacctatgtgactgtataacatcattaaaaaatttataaaaggagtaaacaatgcattaatacagagaatataaaatattatttaatctaactatatttgatatgaattcctattcgttaaatggccacaaatggatatttaaagctctgaataattttccaattccttcatatacttcacaaaaaaaatataaaaattcataacagctgtaatcatgttgaaaataaattctttaaagtgatcgttcacaaaatgagaaaaaaatcgcagaaaaaacatgctcatctgttatcgtttaagaatattagtcagatatcagaagaatgcaacatcacagtgacaaattgtgcacattcatatgtacaggttggccatttgtacgaaaaaactcatcttctataaccctaaagctgaaggaacaatttcagaagagttatcgagtgcttgagatttttttttttaattcatattcatcagaaaacgtgacacaaattaagttttgatgagctcttcaaaaatatggcatccatgaagtccacatttatatgtcaacaaaattgatttgattcttaaatgtattcagctgagaatatttcaggaaatagtcttcacgaatacaacttgttctaaaattttttttcagataaatgtcaatttagtcatgctaacatcatatttttgagcaataacaattgcgtaaccaggaattattaatgaaaccattcattctacggactcgtggctttatcatgtggttcctttcattgatttgctaaacaacaaagctttcttgcaaaaaaatgttaatttatcgattgaatttcgaggtctcgtggtataactttctaaaaattttgtcttcttgaaaacgctccatgccaatattaagacaggaacaaatttttgcaaaagtcaagaatcgtgaaacaaaattaaaactttccacttcaatggcgtgttacttcaagtttcattttaactctacattcatttttcaaagtaaacattagctggtttatcactacgatttcaatttcgaaatggccattgctgtttgattcttcatccagttgctactcttcatttcaaatccaggtttatccattttcgtttacattcttagtaatgtttccaacttgtttaaggatgttttaatgaaatatcgattgaacctctgcctcgattatgaactattatatttgcacatgacattataattttttgtttttgaatacacttttctgtttcatgaaaaagccctccattttttaaattcagtaactgcattgcttgcaaatactttcaacagtaaaatttgaacaaaatgatctcaatttgagggatccattgccaccaggtggcactagcaccatcacaaaactaaaggaaaatctaaacatatcataaaagtcctgttttctgtacatggaagatatttgagaaaaaccattattgaggttctttattaaagcagtaaaacccataacaatgattaatatactttatgtctgttcatttgtgaatgctattctaaaaaacggcgtcttgactaattttggtcaggttttcactaatgtattgttataagcttctccaaacattcagtgtttgaatgatttcagtcggttcataaatgaaaaaattatgtagattccaaaaatcatgtcaaacatttatttgaacaaaaaatacttcgtaaatacccttgattttgctgaacctttggttaactatatttaaagcttgtaaaactgaaatctctttacctatggtttcaggattttatcaaattattatactcaagtaatttgtttagtgaaatttcaaacattatggataatccttgaatattttcaaataagattcattgttgcaatgaatgtgttgaacaatttttcaaaacttactttcatttctcttcatgttatatcatcattttgaatttaaattaatttgtcacttggggctttgttcacaagatagagctgttactagttaacagtctttcttttagacgaaggtttcatacatgcagttgagtcgcgtcaaaatcaatcgagtcccaggcactttgccgtttggatcggatctttcctgcactgatgaaaggtaacacctcgaaaccggtccgtaggtgatcaactcaaattatctcagcaaggtcctgcagctggatgaacaaggcaagatacttcaacgagactaaccttgttgaagtatgtctgccggatataattcaatatccagcgtggtattagccgggaaagtaattatttcccgagaggtattcaccagaacctactgtgtaggttgttgggggagacgcatatttcgagatttcatttccaaatatttattttttagttgaaataatttatttttgaaattcatatttgcaattgtgttaatattgttatattttgttactgctactgttcctgatatatttgttccattttagttaattcaaggaatgcaaactttcactggtatgtcaatgctgtttttcaggtttgtttatggtagtctgcagatttacatacctgaaatttcgtctacaactgcggtgaacattaaaaatcaatgtttcagtttttttactacccacattatcacaaaggagttaactcaactttttcaaacagacaaacaatggcttggtcataactacagctaccgactgagtcagggccggtgggagaaatcgtatctgtgtaaggtttggttcggtgtatgacaaagaaagaatttggaaagaaggaatagaaacttttgtttgcagtttggatgtttactgcccgaataatctaacagactgataacagatttctacacatctactgcacatcttgagggaggggcttctcaccagccatgactaagtccggcagctgtataacacagtcaaaaaatattagatctcaatgatacgattatcagatattgtggctctgtgaaactaagatagtcggcgaaacaggtatgagtatgttgaaactgccatgcaaaacgcagactttcctcacattacaattcaacagaaatgttgggaacaattccaaatcagagtcctcatctccaacaactaccactattttatctttgctattttctaaaagaacgtagtgctggccaacattttccaattttttctcgctgaaagatacactggaaaaaggtatattgatacttccagtgacactgcacctgttgaattgagtcaagtttcgaatgtcaacaactaaaatatcatctggttggttacgaaccaaattaattacgtcatgggcacttattctcggatatctttctttcttgagttcttcaagggtgatgttctctatatcgtattcagttttcatccgatactcctcattctcatgttgccttgctgttatgcttgtgggtgttgttttgaaagtactattcgaaagtaccacgcatttttcaatatccacctcaggtagatcagaaaacagcagaatacattcgttgaaacctgacgtcagcaatcgatctctcagctgagtcaatatcgacagaccgatatgcagtgagtacgaagaatttcccaacagcaccttgtcccacagatggagtattttatatagaggaaaaacgtgtgaaaataacgtcaaaaaccatggtatggcaaaaagctgaggataaaaatttatctcgtataaatgattcgccaattccggatcgtggaacgctatgagctgtgaaaattttgcaaggtactcctctatcacagctgaattatccttcaaaaagaatttgtgcaggaacttcggcacaaattctgacaagcaggcaaaagctttagcttcatcattgaaattgaggtagagaaatggagctgttagagagtcaagtccttgccagtaaacaaattgagaattcttgtatacccaagctttgagaatcctcttcaattttctgtgaccttctgcggatgataataattcgttgtattgatgacatctaggaatgtcaacttcaatctgtcgatctgttgctgtcggagtatatttgtcaattctcatatattgagctttgtaatctcctttgacgtttagcagtgcagcccatatctctcctctgagcagaggaggtatgtctttctctgcttctttgagaattaagtccctggtaaacggataaccatgcaataaccttctaagcagtatcactctttggaattgatattccggatccctttctttgattatgaggggtaggcctctagcatcataggagggtggttctgactgatttattatatcggacttgatttgaattagggggtagtaagaaacgaagggtatgttttcaaatctctggtagagagtgtccaaaggcatctctacaatccggggatcatataatgtagcgggatttctttcctggcccaaaatgctgccttctatgagaactaagtgtggcagcgataacacaggtgggctagatcgaatcaatccttgtttttttagttcttgcagaacatctcctccagccaattgccaccagtgatacaattcgtgtattgtgaaaatttcaaacggtttgcgtaactgtttatttttagatggagtgaagtctttgaaaccgctgaaaatgtctcgctgaagtagttcttcacagctaggccttttttctggatatatattcagacatgattctattaaattttcaagtcttcatctaaattcacgtattcatcataggcgttatgttctcttgaaattcttttcaaaaatggatgtactcgactgcagcagacttaaacctttctattcatggtccagcttcagagactccataagaatctttcagaacaagttcagtgagg

SEQ ID NO: 74 - DNA, 4240 bp, Leptinotarsa decemlineata
  Annotation=Palmitoyltransferase ZDHHC2; Tribolium gene name from OrthoDB database=TC001983; Blast E-value Tribolium Gene vs. Leptinotarsa Unigene=6E-147
gagaacagacctatccttcagctagttcagctgtgttttgttattttaccgtgaaatgacaacaatttcgaaattaaatcactgaaacataatgtagttgagaattgccagattatatatgtcgagtctgattttattcaagttagatccgaaatcttaacaccccacccctttatctttaaaaacagatctctggtttttttgaatacatttggtgaaatgcatttgatgaaaacgatttgatatggctttacctggacgcagcaataggggttcttgttactggtgttttatagtagtcaaatggattccagttttattcattttgactatagtcttgtggtcctattatgcctatgttgcccagttgtgtctattgacagtggatgaggtccccaggaaaactatctacttaatcgcttaccatgttttctttctcatgttctgctggtcatactggcaaactatttgtacagatattggaagagtgcctagtcaatataagattcccgaagctgattatgaagtttacgtgaataacagtgattcttttgaaactcaaaatacagttttagagacttttgcaagacgtttgcctattacaaatctaacagtgagtggaggggttaggttttgtgaaaaatgtaagattgtgaaacctgacagagctcatcactgttctgtgtgtggtgtctgtgttttgaaaatggaccatcactgcccctggattaataattgtgtatcattcaccaactacaaattttttgtgttattcctaggatatgcacttttatactgtgtctatgtgtccctaacatcactagagtattttattgcattttggaagggtgacctgcagggaatgggcagattccatattttgtttctattctttgttgctgtgatgtttggtgttagtttgttgtcactgttttgttaccattgttacttagtttgtgaaaatagaacaacactggaagcatttcgcccgcccaatttccgagatatcggaaccgataaatatggtttccacgtagggagatacaggaacttccaggaagtgtttggagaagatccaaaaacatggttccttcctatcaaaacaagtttgggtgacggtgtagagtatcctgtacattcacgccaccagcagagtacttatcattctatggacaacacccagaacagggaacaaggtgaacttggtggaatcactgaaccatttgtctaattaggtaggatttacgttcacaattgttaataaatcataaccaactcatcattgaataactttaaatatcttttgttgaactattttgtatccaaattctatgtttgtaaatattgttttgacatatgtatataattacattcaacttcaacttcgagcaaccctgtaacttagaatcgaattcaattgaaaatgtttttagctgtgttttctaaaaaacactattttatagcatgtccaagaaaatatatttttagatatacttaataatgaaataatgatatccataaaatgaatacgcacttcacagacctcaaacggatcaaataaccttgaaaatataatttcctgtccatgaaagcatttgcttttgaatgtacaagggctgctcaaaaagtaggtaattataaaaactacctgcagaaaaaaatatctatttaatctcatgttttttcacatcggttctccctctttttttatactagttttctcatcgtctatatactacttttccaacagatcataacttttgagcttgttacagacagtttccacagcttgttgacctcgagaataataataatatatcgtgatcatctgagaacagcatattgataccagaagccttatgttggcaatagtcccttcatcctccttctaccacttgtagaaggttctaccacccttcaccagatatgtttttctggaccattaacattactttttgaacagccgtctaatatatttgaaatttgggacgtaatatataatctctcagcagtttgttttgaaacaattctaaacaaaatggtacaggtgtgttcgaagttcaagacttgatgcttatatatggcgttatgagcgatgacaaggtgattttttaacatgtatgaagatgtaaacagtaaacaggttgtctgaaaatgtcagaaaaaggaaagtactttgaaaccaatgctaattttttatttgccctaaactaagaagcaatcaattctcagtgaaattgagtattattaataaaaaaatcattagtttccccaaatggcaaaatacttatttgcattgttttccatcaagttgtttccttttgttggagcattttttcaatattatagtatatttgagtttgcagttcaactatcattgcggtttgtatattgaacaagatgatgtttaaaatttaggtcaggtctaaatatttaggaaccagtcttaaaaagaaatgtatccaagttgtcatttttgagtgagcacacggtacattgataaaagtttcgttcttgctcatcagaatatttgcaaagtgatttctgaaagttacactgggaatctagtgtgaacatagcaaaaaggtgacttttaaccttggagaggagcaaaatagacagactagcttcaggtttttcattaactagagtttcgattatcttcagtctggtacggtttccactggcatctcgatttattattgttttgcagtagcccacataaagggtacccaactaactccttcatcagtccatcgtcttcctcatctctttcgattctcccagaacccttcggcattcataacgttaggtattgttcgtggtccgatgttagtctataattacttgtatgtgacttcacaacttttaatgtcccttgggtaaacttccacactatgagtaactcttttgaagcattcttgagtatagagcataatgttcttatattcaataaaaactgaaatgtcaggaagcttttttataaaaaaggcggggatgtcttttttcgtagaattggccgttctgaaaaattgtagactaatctaaaatgaatattttgtgataatagatatagatcttagctggttagatagatattatcatagtagtaatgtctgttatatgatacaacaatctgaatactcccgaaactttgaaaactatgataaaatgagataactatttttatcataaaattcttcaccgaaaaggtttcatgcttttttttgataaaccaacaattccacagaactcatcaacatgttgtcaatttaaattctgttacctcctgttgaatatcttattttaattctatcatcgattgtggagatgcttgaattgactagttttgcaagttaagaataatttcatggtcaatattaaatttgtcttatcttaatcgaaagtagagcagctacggcaatccatattgatgaaaaactagtttccatgaacttcttgagataatgacaatgaactactctgttagatgaaaatcaactccacttcagttgaatattgtgacataggcacccataaaaaccacacaaaacgattccagaacttttctgatgaagtagaaaaaggggataataataataataatcgtctttattgttacccagctgtagttacatacaaatacttaaataaattagagagctagttgctgacataacaaaaggcgaagttcaacttagttagcacaagtgctactgagttgttcttctcaatttttcaattgagacttcaatgaagaaacatctcagacctattttgtactaaatttcatgatatataattaaggtcagtaaaaaactcagcttgctgcaaatgacatcattgatatagtaatgtttgctacaatttggcatagtatttcttggcaggtattatgcttggtaatattattggtcactggttgaaaaaaaattagttgaaaaaatttttatcaatctattcttcaaaatagcttccactcttgattcctctacaatctttcagatatcattttgcaactttgtatagtagaaaattatatatgtccagctttggttgatgaatattttttgataagctaatatttatttctgtagaaagtaaactattctgttttgttttaactatgaccaactcgtacaagattcttgttattttgtacgcactgaacaaagcgacgtttttcaaggaatatattataattttcatcactctgttgacaacacaataaacttagttg

SEQ ID NO: 75 - DNA, 1501 bp, Leptinotarsa decemlineata
  Annotation=Palmitoyltransferase ZDHHC2; Tribolium gene name from OrthoDB database=TC001983; Blast E-value Tribolium Gene vs. Leptinotarsa Unigene=1E-157
gagaacagacctatccttcagctagttcagctgtgttttgttattttaccgtgaaatgacaacaatttcgaaattaaatcactgaaacataatgtagttgagaattgccagattatatatgtcgagtctgattttattcaagttagatccgaaatcttaacaccccacccctttatctttaaaaacagatctctggtttttttgaatacatttggtgaaatgcatttgatgaaaacgatttgatatggctttacctggacgcagcaataggggttcttgttactggtgttttatagtagtcaaatggattccagttttattcattttgactatagtcttgtggtcctattatgcctatgttgcccagttgtgtctattgacagtggatgaggtccccaggaaaactatctacttaatcgcttaccatgttttctttctcatgttctgctggtcatactggcaaactatttgtacagatattggaagagtgcctagtcaatataagattcccgaagctgattatgaagtttacgtgaataacagtgattcttttgaaactcaaaatacagttttagagacttttgcaagacgtttgcctattacaaatctaacagtgagtggaggggttaggttttgtgaaaaatgtaagattgtgaaacctgacagagctcatcactgttctgtgtgtggtgtctgtgttttgaaaatggaccatcactgcccctggattaataattgtgtatcattcaccaactacaaattttttgtgttattcctaggatatgcacttttatactgtgtctatgtgtccctaacatcactagagtattttattgcattttggaagggtgacctgcagggaatgggcagattccatattttgtttctattctttgttgctgtgatgtttggtgttagtttgttgtcactgttttgttaccattgttacttagtttgtgaaaatagaacaacactggaagcatttcgcccgcccaatttccgagatatcggaaccgataaatatggtttccacgtagggagatacaggaacttccaggaagtgtttggagaagatccaaaaacatggttccttcctatcaaaacaagtttgggtgacggtgtagagtatcctgtacattcacgccaccagcagagtacttatcattctatggacaacacccagaacaagtataggcgatggtctaacattcccacagaggcagctggaagaagatcaagaaggtcttctacatgagcagacttatgaagatgaaactcattattacacttgaaattgtcatcttttgtaataaacttttgttacttttgtctatagtgtacagtttcagttagggctatcagacgcttatgaaattcattatttcagttagtctcatttttcaattgatattgaatgtgagcattttgatgaattttagatataattgaaaatattttcaatgcagaataaagatactgaagaacaaaaaaaaaaaaaaaa

SEQ ID NO: 76 - DNA, 971 bp, Leptinotarsa decemlineata
  Annotation=39S ribosomal protein L4, mitochondrial; Tribolium gene name from OrthoDB database=TC011518; Blast E-value Tribolium Gene vs. Leptinotarsa Unigene=4E-14; Blast E-value Tribolium Gene vs. Leptinotarsa Unigene=0
gagtccatattatcatgtctatggtttagctgcgaaatttttgaggttagagaactggaataaaatttataaactgtatttagtgaatttgtcgaaaaattttaaaaaatgttgatgaacatcacctccaagtttcgaagttgtgcctgcgtcggcatagctagaagttgctctacagcacttttgactaacgaaaaaataatcgaaccaagaactataaccttcccttcaaagtatcaaaaaaacaggcaagtttggttggagagtttagacacaatagacgaaaggaaactaggattgctcgaactgcatcctaaagtatttgctgtgaaccctcgaatcgatattatccaccagaatgccagatggcaaacgatgtatcgattcgtcagctacgctcacaccaaaaagaggttcgaagttagaggaggaggcagaaaaccatggccgcagaaaggactgggaaaagcccgacatggatccataaggagccccctgttcagaggaggtggtgttattcacggtcccagatcccccactccacatttttacatgcttccgtttttcactagagtacttggcttgacctctaccctctcggtgaaatttgctcaggatgatttgcacgttgttgatagtttggaagtgccttcagaagagagggggtatttggaggaattggtaaaaagtcgaaattggggaccttctgtattgtttgtagatgtcgaagacatcatgcccaggaacataactgttgccactgacaatattaagcattacaatttgatgccagcgtatgggttgaatgtgtattcaatgttgaagcatgacacattggtcctgacccgttctgcagtcgatcatatagaaaacaaaattttggagcttctacacaggaatgatattagaacattaattgctaaatttaaaatagatcaggcttgaatgttttattagtcaataaatgttaa

SEQ ID NO: 77 - DNA, 2164 bp, Leptinotarsa decemlineata
  Annotation=F-box/WD repeat-containing protein 5; Tribolium gene name from OrthoDB database=TC030756; Blast E-value Tribolium Gene vs. Leptinotarsa Unigene=0
gagctgattgaagaacacaagagctgaatactgacaatagtgaaatcagttttgtcaaatttttatttatatttttattattccatattttcaaaatacaatatggatattgtcgagcaaaagaaaaattgaaaacatgaacgaatccacagaaacttattggtcttatttaccttatccagctctctataaggtcttccaatttctttcatataaagaacttgtctgtgttggccaggtttgtaaaacctggaatgcagctagcttggacgatctattatggaaagagttatttttccaacagttttcaattgatagatcaataccagtcttaacagggacaacatggtacgaagaattcaagcgtttgtcatatcatataccaattgtccaaacagaaattttgaagcaacatactgaccaggtactgcatgtcagtttttcacataatggaaaatactttgccacttgctctaaagatggatacgttattttatggacatccaaatatcctgcacaagtcaaacacctgaaaaatatggttagtttcaaatggaaatatactcagtattcccagttcaacgaatctgataccttgctcctagtatctggtgtccacttggaaaatataactagcacttcaggggaaattgctgtattcaatttagatcgttttgaactgcagtgccgcatagtaaacaaaccgtatgatatcttcggtacttggtacagcgatcaatacctgttctccggcaacctaagttggttggctcatctggtcagtagttcacatttgtggttgaataaggcatcccaagaagtggattccgagttggtacctattacccactgtctgttgcgattctacaacatgaatgccagttccataagagcgatcatgatagccaattgtcttccggattcagaaaatgttgacatttttactggtgaagacgaaacagatgctcatcttcagcaaagtagcttttcttcgtgtcatggaaatcctgttagccataacgatctcatgttcacaaagtgtgaagtaagcagagaattggctaccgagaattctgaaacaatttggtataacgctgattatcgcaaagtagaatcagagctgggaatactagatgatctcagtgacgatgaaatggaactacctgaaaatattactgagaactcagacgaaggatgttcaggatcatcttcagaaccagatagagacaggtgaatctcacggattcagttaaaattttaatatcgatttataaataccgacaaatatctcatcttcacaacaggctataagacgtacacccctcaccagataggattcaaacggataaaaccattcaagtttcctcaaaggatggatcctggacctagtttgaaggagcgagtaatcataagcaaacaaagggatgaacaaatgaggtctggtagtccgccaactttcccagattggtctgactttgagaaagtggcagacaagtttgataaaatagatcacctgatagatctacatggccatattgttggaatggggctgagccctgatcacagatttttgtatgtaaatagtcggtcttggcccgagaattacgtaataagcaatcctttggatccgccgcctatagcacaagaaatcgacattcacgttatagatttggtaactttaaagcaagtgggaactatgctcaaagctcataaggctttcacaccaaataatgaatgttttttcatttttttggacgtctgtaatgaatatgttgctagcggtgctgaagataaacacggatatttatgggacaggcattatggaacttgccttattaaatttccccacgacgatgtagtcaactctgtggcgttcaacccaaaggactctgaaatgttggtcactacgtccgacgataatactatcaaaatttggcgttcaagagccaaagtacaaagtttgggtttagaagaagttcgcctgcctagaggcatcgaactacgaaacaaaaataaaggtacacgagtcagataacattgcagtagattttaatttatgatgatttattcaatatattttagtgcttaggtgtattttttctcagcaattttattgtggtttcgtgtgactttttattgagataatttgtgaataaagaatcat

SEQ ID NO: 78 - DNA, 1430 bp, Leptinotarsa decemlineata
  Annotation=Ribosomal protein L31; Tribolium gene name from OrthoDB database=TC008311; Blast E-value Tribolium Gene vs. Leptinotarsa Unigene=1E-65
tgtgaaggaggtatgttagaaagtaaatttttttaaaaactcataatcatcctgttttctagaaacgtgaattgtccatacaaatttcacaaaattttgccattttctgttcttattatatattcaggtcgcaatggcaaaacagaagggagaaaagaagggcaaatctgccatcaacgaagtggttactcgtgaatacacagtgaacctacacaaaaggttgcatggtattggcttcaagaaacgtgctcctagggctatcaaagccatccgacaattcgcagaaaaacaaatgggaactccagacgttagaattgacactagacttaataaacaattgtggtctaaaggaatcaggaacgttcctttccgtgtccgtgttagactgtccaggagaagaaatgatgatgaagattcagtcaacaaactgtatactctcgtaacatatgttgcagtgccaacattcaaaggacttcaaactgaaaatgttgacgcaagtcaggaataaataaaatataaaattatttttaagtaagttgtgttttattctttcacgaaagctaactgaagctgaatatagtctctgtaatatactcaatgataatatttcacctgacatgtcatgggagagattcattacaatcaaggcttgaaacaaatatttgtgtgatacatttcaagtgttgttgaacccttgtttacaaatattctccaaagtaaaaattttttataagaagtgtgctttgagaagactgctacatttctggtgattggaaaaagtgtccattttagacaatagtatgacatcgagagtgctaaacttttttgtttcaaatgtaaaggggtcttgtgatgtctcctttgatacgtatttcagttctctatacaaattcattcactatctgacataatgaagtctacaaactcatttcttacgttgaacaatgttgctggatgcaaatacctcttattcaatctatgaattctggaataggctgggttgtgtaacacatactttaaattccatgaatctccataaaaatctaggaggtcatatcaggtgatccattctgagaaaatatttctatatatgcaatgattttggataattttcctcaaactttattcgaaccagctcttgctgaaatgtaacgtcaggtaaaaagtcatttggattttcatgaaatattgagtatgacagtattttatggttcggttgaacactcttccaaaaatattagtactattacaccataccatggttggacaaaaaattccaatagtttgttaaattatcacaaagtaccatcctttttattccaataataaacggtatctagtataacatacgaaattacctcagaaatgtgccaaaatatatgaaatgaatttgtgaacagactttattgttgtcaggaagtggatgttga

SEQ ID NO: 79 - DNA, 2882 bp, Leptinotarsa decemlineata
  Annotation=C-type lectin; Tribolium gene name from OrthoDB database=TC013911; Blast E-value Tribolium Gene vs. Leptinotarsa Unigene=1E-6; Blast E-value Tribolium Gene vs. Leptinotarsa Unigene=0
gattaaaagtacttagcatacacatagaaatacttttatttgatattaatactattattatttgatgataataatgaattcccccactcacaagaattttgtcttgggctacatatgaggattcgatctgaaactcattattattgtcagatctaaatctaattcttaaccatacacactagatttatccagaactaaatctatctaagactattaataaattaaataattatataaattcattcagcttatatatttctagaatacacattcaatgtggctttgggaagtgatacctattttaatattatttataatacaaaacacaatgaacacaatattatatgatttccttgatttatttgaaagacattgcccgactatgctgtggaaaaacgaaaatcacatacaaaaaaaaaacatatttcattcttacatttgattatatatagatgaatactattcgcttacatataaactaatattatctttcaaatgaaaacctcaaggttcttaacaattctggaacatttggtcaaaataacgatattaataattttcacttcaaattctaaatgaaaacagatcaagcttacaaaatataattattagatgaacaaatttgaagctttttggaaaaaatggggcaaaatataaatacaattatggaaaaaactagtgtaaatttaagtgaaaataaagaattgtaatgaaaattatatttttttattgttttttcttggtcattgtcaataatatctgaatattgtttcacagtttttcacatttactacaaaaaatatttgaaaatttaacaaatctggaaactggcaaaattcaagtataggtacataagaacattgctattctctctatgacctgtagataatcaacaaatctattttaaaaatatgctgctttctctcaaaaaacagagaaacaatctgatactgctctgctaatgggggaatgggatttctttctttaactttggttaaaatggatttttcaacacaaaatacccaatatgtttcatatatcaagttatttttgcaaaataatcccaaagtgttctgaagacgaacacttcggaaaaaagggtgattcaacaaagtaattttttgtacaagaagtgtctaatagcttcgtatatagaatagtctatatgcaaagctaatatcatctgctcaaagtcagaatgataccaagggctagaacacaactcaatttttgttatgtattttaacatattcattgaataaattgagtagtatcgtgaaagttttataatattctgtgacattattcttctattcattggtaggtaataaattcggagcacaccaaatattcaaaaaaacaagctttatagaatattcaaatcagctagagtgggacaatttgaaggcttttctggaagctgacactgttatgtaagaaagaggaattctggggcagataacatgatttatagataggtacatttttatcaaaaatttagtttagaaaaaaatcctgtaaaatgtgtcatgtaccttgtacagagtttgtccagagatctaccatcaaccacaattcttcttcatatcttatctctctgacgttctggtctttttataattgtcatggagattttttaaggaatatagaatagaatgaccttttctcaagaacgactatcattggtaataatctgaaatgaatatcaaatcgataaactttgaatgccattacgaaatctctcgtacgtattgaaaaatatgtttaaaattacaattgacaatattcgataaggattaaatggtagccgcagatttaccgcgccataggggaagcaaagaccataaaaagataaaaagaagaagaaatggtagccggattttatatttcattgttggcaccattgaatttgtgtcaaatcatacagttccacttttttccattagatggcgcaacatgaaatttatgcggtcaaatttgaaattgattatattcgtgaaaaataatgctagccgtcttttgaaactagcgttcaaaagacgtagaagtggtatgcaatcacacaacaccaaatgcctcccttttcgtcaaatgaaatacggtccattagagtcaaaaatattgtccaaactctcccaactccgctctaaatcaataaattcggattggtgtaccgcacatacttcagaagatcatcattttcttcacacacccaaggcttgacgtgatggcaagcaacatcgtgccagttgactccgtcgttgtaaaactggttgagcacagccaaacagttctcggttgctcccccttgatgcgcttcacggttgtctggttggggttttccaatacctcccgtttccgaccaatcgttttggtccctctgagtggttggagccaatttttgaagaacagccgtccagaaccaaccgttgatggagatgggttgcaagtcgggacgttcacaacctttgaagtcgcaaattctgccggaggtccagatgtatttcaccttctcgtccaccaaatgttttttgatccattcattttcagcgcttgtttccaatgaaacaagatccatgcaacgctttctgcaataatttctaccggacagccagtcttgttcaacgcctttagtattggggtctctccaactgaagaaatatcctttaccatctggtgtcctttcatggataaccctttgagcgcagagggtgggaactggaggttctaatattcttccattttgattttgagctgcggaaattgcgaaaaatccgactacaagaatgaaaaggctgttcattttgatttttgattttttaattcaattaaaatcgacacctgcacaaaaacactcgcaacaaacctcatccacaaactaa

SEQ ID NO: 80 - DNA, 4862 bp, Leptinotarsa decemlineata
  Annotation=Transposable element Tc3 transposase; Tribolium gene name from OrthoDB database=TC000041; Blast E-value Tribolium Gene vs. Leptinotarsa Unigene=8E-16
atgatacattatctgcatgtaactccaatggtataggcagtgcacgccaagttagctctcagtatggatggaacaagtttaaagtccattatcacttagggatatatatctagggtataccgtaggcccctaggccattattctatatttttttaaataatggttgtgtctggaatactgaacatttgccatgacaagtgataacaataaaagttatctattggcaaataccaaacagtagttgacaatagtacttcagtcaaagtacaatttacaaatgatgcaattttttatggttttgttactgtgactcaaattaagtttgtgatccaagtttatcgccgagtattttgctgacggtttgtttttcattatttgactgtcctaatatattagggtgaaaacaacaacccattgacatagaagaaaaatttccaactatctgatggtaggatccattgttttacattgtataaaatcgagaagtttcaaagtatatttggatgctgagcccaatatatattataagaaatattctaggatgtgtcaaatctgcaaaagttgcttggaaagtgaaataacttccaacacgtaacataattcagagttttccaaatactgttatatactgcaatatttctaatattttatctgtttaaaatctgtttttccgttaatcagctgtcgcacccttacgaacgacaatcgtcagaaggactaacgaggtcttaccttttaacgtgtaattcctaaaacgggttggatgatagcaagtaaaaattgaacgttcggcctggggcttgaaccactgatcggctaccgaccgacataaaaaaattccaattgtttcacttttttttttcctaagtcaaataaacaattaacctgatttaaaatgatcagttcatgtttgattcatgatttttttaaatatatcaaaacaaaaccgtcatttgtttcagactttatgggtgaatctgaattatgacagtttaaagatatatgtaactttgactgtaactggctaaatgtgccatgccaagaaaacctaaagagagataactttgaaaaagtaattgacagaaaactatctaaaagtttcttatttgcctttataatgaatgaatgaaattcatgaacctcaaattacaatttctgttacattagaaaatattcgcaacacttcaatcaactagaggttaattaaaatccattattaaaaatcactttgaaaactaattatcaataaatttgtctttgaccactgtaggttgtaaaaataatcagcgcatgaggttatgaaatattttttgaagagttgataaccttaactacaatttcaatcttgtgaaatcatacagtagtaaaaactaattttgtatgcaaagcgcattcaagactagtgtctagtgttttctttgaaacattttaatgttaaattcttactagaaattcaatctcatctctttaaacttgaagtcgcataaaaacactttctggttgggtaatgtcacaaatctgtttttatgtcactcagtttatgaatatcttttctgctattatacaatgtggtatctatagtatatgtgaactattatttatctaatgaatctcccaaagaaaacggcaaaataagggacaacttcaattttattcaatatctgataacttccaaagtagatacaatcaaaaacaagtataataacaatacagtgcgaaaagatatgacagactcgctgttgccaagccgatgagaaatacgactcacaagttttgatgtccctcaagtttgattgtgtcgaaaaatgcacacaagtatttatacctgccaattagccctctgacgtcaaacgtttttgatgcttgtctctttcaaatttctactacttttactgcagtattcaagttttgttatttttttgccaatataaaaatatttgcacatgacctgttagattttgttaatctcttgtcaatattagactgaattatttttgcgttccatttaatttgcacctaataatatttatttaatataattcgagtctttgtttactatggatgaatttttgagggctgggttgtttttttgccaacctaacgataatatcatccgttctttctgtattacctaaatgatatcattcggaaagatagcctgatgaactaattttaaaatataaaaatgagttttggttgctctttctgacaattgaaaaaggctgtttgtttccaaatccaatatattcaataaaaggtaaaaatggaaatttgaaaacattctttaactgctatacagcgcatttctttaatgccccccccccttaattttttgaacggatcagctcggaaaattgaaatttgggataatgaagttaatgcataaatactttattttgaactgaaactgacagatggaaatttcaagatggcgactgggcgccatccgggaaaaaaattaaatgggaaggaggtcttgtgacatcattttgaagatcctgatgaatacttcacaaccctagaatatgaagtcaatatcttcacctactacaaaatgtcggaacattataatttcctgaagacaaacacattaatattgatgtttctagaaatattccgttttatctgcaatttggcaattccaacaacccgttaaggtttgttaaattatttttgtttataaaaacattgaaaagtgtcagtacgacaatgaacatcattgttcagttgaaatatcctcatttagttttcggttttactagtagaaaggtaccacgtcaacaatctctaaaatggtcaattcaagtccattggaagaaaaaattgaagcgatttctatttacggtgcgacgtgtaactttcacgagaccgaaaggattttcaatgaacacgatgaagcaccaccacattactccacacaagtaagaaactatttggatactactttttccggtcgttggattgaccgtcgaggtcctacagaatggccagcccgctcgccagatttgacacctttggactatttttatggggctatttgaagcagaaggtgtattcatgcattaatttcattatcccaagtatcaattttttgggttggcctgtttttaaagataaagaaggggggacattaaagaaatgcactgtatatcaaacatatggaaactgtatgtaaagctttcttttgagtaaattacagtatattttgaaagtaaattctatattcacattgatctaatatctctctgtagacgtgaaagtaagttgtgtgtttctgtgaatttgaatatatttcttcgctagaaaatttgaggcacataattagttttagaatgcttcatttttttatccaatattaacagttattatttcaggataattttttaaagtaattttagtttgtctgaatttatgagtataagttcagaaatgtttgtgccttcttggaattgaaaataaatgcaaaacgttcttggctttgtgaccttttgttggggatgtaaatattatcagaacgtttgagaaatatatcaccgtaattttatacactgtgatttggcttttttgcacatgcactttgataatctattcagtgatccgtagtggaaatcttatgtactggagggtgacaacgaaaaatttgaataataaaaggagttttcagaaaaattcaaagtgtgacggttatcagtttgtgaaatactctaagcttatcgtttacactcgtctttaggttcgccttagattcttttatgatgaaatataatctgctcaatcaagtctagcctgaggatgtctgaattttaacaataattgaagatctcacttcatttgtcttgactcggcaaatggaaatgcttgaatgtattaatattttggcataaattcaaatctagaaactcctgactaatgttactacatacgttcatagttccctggcatagccagacaggcaatgtgaaggctagataaaactgattaaaaaaaattaagtagatcaaccaatgaagccaagtggctttgtatgggtatgagaactttcgtattaatgcatataattgcaaaaaaaaatgttgcaagtgtcaattttgtgacatgtgacaatatgtgaacactagaggaatttgctcttttctaatttctgaatatttacatccccgtatgcctgtgtcccaattgtttacttatatttatttttatgtttagctaccgtcaaaatgtatcctgcacctttgtgatgcaagagttggccttcaagtcggcagaggagtgcttagaatttctagaaccgttttctttgagtttcgtcgattcacaaaggacgtttattgattgcaaaagtagcatggccgctctccccaatatctagtgttctcctaacgtgtttctcccaaaaacatttaacgaattatttcggctatgtgattctttctgaatatttattcttgaggaactttctcaaggaatatttctctcctttccttgtctttagaagtgttatcgaggatacgtttgcaaagcacctgtcttcaaattaatggtcaccgtcagggagcgtcgcagtggaattcagaagttttttagggttcttgggagatttctaatactgaaaaagatgacgagcccttccagttatgctgagcattttttacaattcacttccgtatcatccattatctgagaaatttgtacgtcattgttggtttcggttggaattaccaagttgtacggttggatattcaaaactcattttgccatgttgtagtggcaatatgagtctgagatgtgtgtacatagtcaattgttggaatatgtatatatgtaaagtaagtaatttattaggaaaatatatacttattgaa

SEQ ID NO: 81 - DNA, 2964 bp, Leptinotarsa decemlineata
  Annotation=Leukocyte receptor; Tribolium gene name from OrthoDB database=TC000041; Blast E-value Tribolium Gene vs. Leptinotarsa Unigene=0
catgttggcgttcgtatggcagaattgaagtgaaatgaaataagtgatttttgtgttcacagttgaaaattttatttcggacgcgttttttatcgaacattaagtgctcattgatattattttcatatatttactttacagattaacttggagagaatctaattttatttttgtaggtattatgatgacggaaagttctacgatcccacctccacctgggactacggagaatccaccattacctccagaaccaccatcatcaccgcctccgcctctaccaccaaataccgccccaaataaccaaccgcaaaacaactgggcacaattctattacagcggttattaccatccccaatacgcacattattatcaacaatattacatgatgcagcaaggttataatacttataatcagttcacacagtttccagataaaaaagaagacaaaattcaaccgcccctaccgccaggccctcctttacccagcatcccttcgaattctccccgaccccccttgttgagtactccaaaacagtttggcagtatcaggtttcaactgaatggtaaaagactaccgaacaacaatgcgattttgcagttgaataactctccgaacagcggagcggctaagaaaaaacgaaagcgtaacaggaacaaccaaaacattcagaaccaatttaatcaaacaaataatttcggtattcccccattacctcctccagagttgagcctccccaagccggctcctcctccagaaaccatgcccccggaaccccctcttcccccactaccggaagaaatgaaaccccctgagcccgttcaggagcctccatcgtgcaattctgccccgaaagggatggcaaacccgtccgatgattggcctgagagtctaagaacttacgtgcaccagtgctacgccaaatgcaagactaacatagataggaatcaagtggatattatcttgaaggggaaaattacccaggcatatcaaaacaatcagctgcacagagattggagcaaggaacctcttccaacggttcatagtgaacgccccccgttcacgggtcagctcaaaactgtcccgggacagttgagccaatttcagaatctcaagaagggcatatctccgggcttgggtgctaggttaggtgctaggtctaatgtgctccggaagaagagcagatcttcttctaggtctaggtccaagtccccacccagcaaaaggaagtcgaggtcaagatctcggtcaaggagtcctagaagacaacgtactcaaagtggaagctctgactcaagtagcgatgaaaacttcaaacccctcacgaaatccagcaagaagaacaaaggtaaattatccgacaggttaggtcctactaaaactaagttggcgaaatcttccaagaagcagaaagcaaaggagaaaaaagcaagtttttattcgacgtttggcagtgaacttgaagaaagtacggaggtgttacagcagagagctgctaggttcaataacggaaaacagaacggtacagggagcgcctcaagcccggttaacgataacaaaaagcaaggttttatcatcgataaatttagtgaagataataattcggtggactttgactggtctgaatgtcacattgtgggcacgtgtcatgatttggagaaatctttccttcgtcttactaaagctcctgatccatgcgacgttcggccagtcgaagtgctcaaattatcattgcagaatgtcaaggagagatggttagcaaaacaagattatttttacgcttgcgatcagcttaagtcaatacgacaggatttgacggtacagggcattaggaacgatttcactgttcaggtttatgagacacatgcgcgaattgccctagaaaagggagatcacgaggagttcaatcagtgtcaaacacaattgaaaatgttatataatgaaagagggggttccagtcggaatgagtttatagcttacaggatattgtactatattttcaccaaaaacaccctagatataatgaccattatgaaatctctttcggcagaagaaaaatctgatgagtgtatatctttcgcgttaaaaattagatcggcttggggttcgggcaatttccacaaatttttttatctttaccgtgtcgctcctttaatgaccggttatctcatcgactggttcattgaaagagaaagaaaatcctatcttaagtgcattatcaaaaggtacgtacacatattttttagaatagacattgctgcataatcggtggtgtttcgaaatgtttttcagcagattatttaatggcaatcaaaaaagtgaaacaattagaaattttaatggatgtatacgatgtgtcgctttattgcaattttgtgttgttgattttggattgaatcaattcaactgaaccatagtaatatatagatgcctatcgaactggtcagctcaaaatctaaaataatgaaaatagtttatttgaaaaaaattcaatattggagatgtcttcatctccctacaatgttctttatttcaaaaaggcattcaactcttgtttcagtttgatcatgttttctggatattaatgtatctcaagatatttgttgtagcatttgatttatatgaatccatgcgatttttgtcccaaagttatctttgaaaatgattgatgtgtctgatcttcatttatggttatactagttgttgcccgtggcttcactcacgtagaatttggtttgtcacatcaagtttcgtgacagaccattttaaacaaatagtttcaatatttttttatcaactcaaaacttcatctttccaacttcaaaagtgaccaaattcaacacaatctttgaagccctattttttcccctttgggagtggaaattcctgattcccttttttgagtcttatttacgctatacaaagaacctacctgcatatttcaaaattctaggttcagtagcttt

SEQ ID NO: 82 - DNA, 2576 bp, Leptinotarsa decemlineata
  Annotation=Heat shock 70 kDa protein cognate; Tribolium gene name from OrthoDB database=TC000487; Blast E-value Tribolium Gene vs. Leptinotarsa Unigene=0
acattatatagcaaatttattgtactaatcaacagaaatacatatcagataaaaatagttacggaactataaaaaaacaacacataacaaatccatacagcattcattctctcagtcagttctgcttcaagtattgtgaattttccctaatcaaaacagctccataaacaaaaactggctcatttcaattggaaaaacaatgtaatatacgttttcaaaggtgatagatttaaagtaaacacacctttcaacaaaacgtaaccgatttcatcacaaaattttacactagaatgttttcaactcgagttctgaaaacttaatttttctcctcctttttctcttttggttcctcgctgctctgttgctcctgactgctactgctgctggatccctctcgttctgcggccattttcttgtatgccatttcgaatagtttaagtgaagactgctgcaatgttgaggtagctttacgcatctcttcgggatcaacgtcgtctttcttgcccaacagctctctaactttggttatttcttccttcaatttgtcacattcttccttgggaagttgatctttgtactcttccattttggtttccgtatcgtgaacgataccttcagctagattcacggcttctactctctccttcttcaccttatccgcttgtgcgtactgttcggcgttcttcaccatgttttcgatttcgtctttgctcaaacctcccgaagattgtataataatctgctgttctttgccagttcccttgtctctggcagatacatgtacgattccgttagcatcgatgtcgaaggtgacctcgatttgagggactcctctgggggcaggggggattcccaccaaggagaattgaccaagaagtttgttgtctcccgccatctcacgttcaccttgatggactttaatttccacctgggtctgtccgtcagcagcagtggagaagacctgactctttttcgtggggatggtcgtgtttctgtttatgagacgtgtaaacactcctccaagggtctcaattccaagtgataagggagtaacatccagaagtaagacgtcagtaacatctccagccaaaacacctccctgaactgcagctcccacagctacagcctcatcaggattcactgccctactgggctgtttgccgaaaatatcctggactgtgctctgaacctttggcatcctagacataccacccaccaacaaaatttctccaacatcagacttagctacttcggcatccttcaaagccttctggcaaggctggatggtccttttaatgagatccccaactagactttcgaattttgagcgagagagtttgagattcatgtgttttggtcctgatgcatccatagtgaggtatggaaggttgatgtctgtttgaagcgaagaagacagttcgatctttgccttctcagcagcttccttgagtcgctgcatcgccattgggtctttagtgatgtctataccttgttcctttttgaattctgatacgagatagttgacaagaacattgtcaaagtcctcaccaccaaggaaggtgtctccgttggtggattttacttcaaatacacccttttgaatttccaggatggatatatcaaaggttccaccacccaagtcatataccgcaattactttatcttctgttttatccattccatatgccagagcagcagccgtaggttcattaattactctcaaaacattaagcccagaaatttgtcctgcatctttagtggcttgtctctgagaatcattgaagtaggcgggaacagtaacgactgcatttttaactttggtattcagatacgcttctgctgtctctttcattttcactaggacaaaggctccaatttgacttggggagtacatttttccatcactgccttgtacccaagcgtccccgtttgatgctcttactattttgtatgaaacggttttcatgtctttcttgacttcatcatcttcaaatcgtctgccaatcaaacgttttgtggcataaaatgtatttgcggagtttgtaacagcttgtctttttgcaggcattccaactaaacgttccccgtctttagtaaatgctacaaccgaaggagttgttcgagaaccttcggcattttcaattactttggcttgctttccttccatgacggcaacacacgaatttgttgtgcccaagtcgattccaataacagcccctttgacaccctctgatttgtttcgtaaatgtacatcgtgttttgggcctagggcacataaaggtgatgtcttgttcaataaatggctgaaatttcgatttcctactttgtcaaaatgtacttttgagcaatcgagggctttcctactcagggcacgtgcggcggatagcattttataatattttttatacttcgtaatacaacttttgaaaaattaacaggaagctcgtacttttcacgtgtggaatatttcacaaaatggaaaccggcctctttcaataaaggtgacgatgttctcgaacaactccttcggttgtagcatttactaaagacggggaacgtttagttggaatgcctgc

SEQ ID NO: 83 - DNA, 4716 bp, Leptinotarsa decemlineata
  Annotation=GTP-binding ADP-ribosylation factor ARF6, putative; Tribolium gene name from OrthoDB database=TC004744; Blast E- value Tribolium Gene vs. Leptinotarsa Unigene=2E-115
agaccagtgcggttgcgcattccgagaaaatttaggtctttgtcggcgaaacgaaaaagcaatatggggaaaaaaatttattgaggaagtgttttgttgaaattagtttttaaaagccgtcaatgctaaatggtaggtgattaatatccatctcgagctattgtaaaatcaaaaaccttatattgtcagaaatcgctcttgttcccgttagatgtccgccataacatgacatgctgtctaaaattcctatctgttgtcaaaactgtcaagtcaagtgatatctcatgaatacttgcacgaagttattcgcctccccttcattatcttgaattggaatgtggttaactcggagaatattacatgttggtacatttctttgcagataggaaaagtcacgaaagccctccaacacgatggggaaactactttccaaaatatttggcaacaaggagatgagaatattgatgcttgggctagatgcggctggaaaaacgacaatattgtacaaactcaaattagggcaatcagttacaacaattccaacagtgggctttaatgtggaaacagtgacctacaaaaatgttaaattcaatgtatgggatgttggagggcaagataaaataaggcctttgtggcgacactactatactggaacccaaggcctgatctttgttgtggactgtgccgatcgagaccgcattgatgaagctcgccaggaattacatcgtattatcaatgatcgagaaatgcgtgatgcaataatactcatatttgctaacaaacaagacctgccagaggcgatgaaacctcatgagattcaagagaagttggggctcacacgaattagagatcgaaattggcatgttcaacccgcctgtgccaccactggtgatggactctatgaaggactcacatggctgacaagtaaccacaagttatagcatccaggtacccattcgttttagtatatgactacaactgttgctattgtaatattcatttcaagaggtgattcggtaagatgtaggcccaagcctaacctcaacattccaaactgccagttcagagttgcagaaatagtacttgaactgaattgtgtagtgtatattgcggccgtgaaaaaattgtccctagtttatgtcatttcactatccatgatcggttgtgatttgatgtatcagacccggtgttcttgagattacctcctacgtattttgtaaataaatttattagtattattttatcaacttgttcatattgttgctgcatttagaagattcaagaaagtactacatgactctgttgattttagtactggagatatattaacactttcggtgtgttatacactaataataatgtaatttatgtctcttgtaatccaaaggtcctacacatgtcttgtcttgtgagttagaatatccaataaacacagtatataacagtttgctgcaaataatgaatttagtattcaactatttgagtaatatagttcatacggcaattctcaggtattgctgttgtgaatgttcatttgaacaattataatctaaggcacacgaaattatgagtaattcgtttatattcatgaacttttaaatatatttattccttggttttcatatctttgaaatgtttttgtttctagttggatttttctggattctgatactggaatacccatgactgttgctaccgtaacactgggaaaacctcaaggaatttcttgaattgtctatactgaaatataattctagatatttattctacagttttctgattattctacagttctgcaccaaaaaaacctcaagttacctacttttcttgttggcaataaataattaattaattttgaaaaatgagaattgtaactttctatgttttttaccacttttaaaaattattatttcctaccacggctacatccatcaatttattgaaattattttttttcactttatcaaagaaagttcagactcattgaaaaaaaaagattacgctgtattaatgtgtgagaccttgggagattgaagaaaataaatatgaacaatctattgaagaaatgtttgttaatgacactacacccggctagtcatgaaaatatgtgaaatatcatactttaatatttttgagaataatttgtgtacacgtgaatggcttttgaaaactttaacctcaaatgttattattcaaattttgcaataatctcatttcttgctagaaaagctaacactaatatgtaatatgaaactattactagtttcctgttttttgtatgtattcgtcattaattacgtgagtgtacttgatctgttacacctttttataattccagtgttataaagctgtaaaagaccacaatgtactgctatttgaggactacacccaggtcgatttgaagataagggggaggggggagtacaactagaattatatgttacacttttttgttgtataccttttgatttaagaaaaataaggattgagacatggtctatttgaaatactattttttccttcagtagcttgccattctggtaaaaatactctattaatgactgcaaaatctaccttatttgtatgtgtgatgatatatttcataccacaaaaataattatatgttcaatcatctttaatggcctttccacttttttcaattgttagttttggagataaatctgttttcatgagatgttcacatgaaaacagacattgatgtgattgtcgtttcctctgtcattttcaaaggggtgtcttactttaatgtgggatataataaagatttctattggcgttcaatggtgaattcaagatttacccttggatttatggatttttatgagacttctgctccgaatatacactgctgtttttcaagtgaggcactccttgaatttttttatattctgtatctttgacctttcaaaaacaaaaaatattcatggttgtgatgtttatgattatctgttggtacataaccttttacaataacttggtgtagatatcctccatagcagatctttttttcatttttgcaatacctattagtgaaagtaggtacttgcttacaaattcatagctttgtcttatattatttttgtatattgttttgtgaaaggttgaaacattattcataagtcatgtatacaataacatagttttaatcagggttgtaacagaaccttgcttcgggctccgcaagttttttaaaggagttttaacttttgttcgtcacttgtatactgttacacttgttagctttcctaaaaacgtagatgtttcaaaagtaaatatgcatatttctagttgagaaattgtccacgtcttttcaagaaagctaagtatataaaaaatatcctatcgttcatttattgacgaaattgtatggcggaggccaacttctgcacttccgcctctgctactgttgttccgttatgttacaacactggttttattatcgtctcatgattgtggtatcatatttagtaatcatatttagagtttttatttttctttttatttcataatgccaataatacctttatataagtcaagactgaatagatgtaagatatttttcagccagtcaatttttttcatttccatatggagtgtggctggatatgtccggtgactatatattttgcaaaatattaaatgttcagatccattttgttgaggtttcatcaactaatggaaagctgttgatgtctgaaattcttccgttatgtatatgtttaaacatattgaacgaatttttttttggaggaaaatcaattttttatcaaccttccttgggtatttttaattcccacattctgaaaaatatgaaaattgtaatggagatctttatacacgtgtaaacttttcagtttaccccgatgagatatacgtaaattcaaagtatttctcaccaacacgaatgttttaattatcagtaacttgtcatgttcaataattttgcttatcaaaaaaataagtttagaaattatacaaactaaaaagtttgccctttctacacgtgaatgaagttctccattacaatttttatatattttagattgtgaaggtaaaaaatattcaaaaaaggtcgatgagtaatgtttaaaaatattttaaattaaacataaatgtcataaaatgatatttcgaaaatgtttgattatagtagaagtgaaagagcacatgataatagtgaaaatagtaattctccctttgtatttgctctctgaaagggccgatcaaaacgttcatattttttctgaataatagaatccatgggtaaatgcacaggctttgtaggaaataattagaaaaataaaacacgacatcctaggggcagttataaaataatttgtcatgctacatcgctttatatattaattcaataggttccttattctgttttgtatagtatatttgcaaggtaaactgtttttatgtatatgtaactaactagaatatattttatttgtctattctgtttatttgatgaaaatgtgtaaattattgaggtaatataaattatatgagtctgggaaaaatttaatgaaattaatattgccaagaattattttgaatgtataacctttataacaacaaattttttaaattatgatttttttaataattttattggagctataataacatttgtgatacacatgattcttttgaagtaaggatgaatcggcaatataaataaaacgtttt

SEQ ID NO: 84 - DNA, 4151 bp, Leptinotarsa decemlineata
  Annotation={NAD dependent epimerase/dehydratase; Tribolium gene name from OrthoDB database=TC000317; Blast E-value Tribolium Gene vs. Leptinotarsa Unigene=4E-17; Blast E-value Tribolium Gene vs. Leptinotarsa Unigene=0
tttcaatataggtataatagtttaacagtagagttcaacagtagaggttgattaacaatacaagaataatgataaactaaattgagcaatttttttttgcaaattgacattttcagttcgataagtacctacactcaaatcacaaaaataatgtggaatgtcactttcaacctttccacaagaatagaaaaaaggttttctaaatgtagaaacaatagaaccgaattatacataaaaaattatatagactgagcgcaaaatacttcaataaaaagtaattatcctaacataattaaaataagcttcataaatgcaatcaatatttaaataaatgatacttaagactgtagaaagcaatttcaattatactagtagtaccatttcgagattgtttatatttatatcgaattctgttcttttgctgattgtcactggttcttattagaataactcgaaattacagaatagtcctcaagaagttaactgtacttatgttactttcagctcgatcatagattttatcaaacttaacgcctacctcaaaatatattcaccctgtgtatacaaattagaaagaaaagatatcacagagtcgcatgattttccaaaaaatatacaaaatatatcgacatttttcaaacagttaactctctaacaagcagggtgtagctaagtctatgcatatcgttttgagattccaataagtactgaggtttctgaacttcaagtattaccaccatcaagtcaagatcaatttatgtacatgtacaattcagaagtatttattataaccaccttcattaccattttaatttcagcacttttccaacactacttggtactttgaccaatattgatatgcaatattcaactacttttatcattagtcacaattttgactatgattatagaattgattatatgatatgattatagaaaattggttcactttgctttttggccaatactgttttcaaaccttataccagaagatcagaagaattcatttttggagcctcttatgcttatatcatttcaaaacagtactcattaatcacactgaatatcttttgtgcagtactgacatttttggcatctgaaatgcataaatattaactaagaatataataaagtacccattctttcgatgaaagtatgaaaagaaatgaattgttttcatcattaaaagagcatggagtactttttccaattggaatcttttaaaatatttttcatatattatgagcatcttctgaaatactgcacctttttcaattttaccagtatttatcaaggtcaattttcatttctggaatgaaaattccagattgattgattggttaatggcaataatgactattttctatgaagtaactgttacaattgtgatcatttttgtatggccatgtggaagaaagtaactctgaagattctggttttacaattcaagtacttttttatgtaatgcattatgtgtacaatatattcgaacatgcatggtctcaaaggaatttttattacagtaacaattcagaacacgtctggcgtaacactgaaacatttcaggtagttttgcctggtacctgtgatactattgaaaattttccatttcaatgaaaaatttgatttcaagaacaaaaaaactgcgataatagcattaaacaatcataaatattgcatctctttgtttctatttcaaattatttgacactatttttgttcagtactcatcaaatacataaggttatggtatagtaagttttatgttaataacactccttatatgaaacgagtcacaaaaaatacagtccactttgaatgaatcactaaaaggaagtttattttgttagttactacacttagccaaatactttttgtccaatactgcaaatgaacaatggaagatatagaaaactgacacttgaaacaatgaaaaatatttaatttaatatcctctattcaatagagtctattgtatagtttttgtggcgatgcaagaaacatcacagcaagttttaattgaaattaaaaaaggtatcaaatttcacccccagaacttttttgctgtatcaattttaattgtattctaatttattgtattttaattgaatcaatggcactgagggggttactagtcactaagtgaaaatatttttttccagaaacgaaagaagcaataattaataattgaattaaaattttagaacgaagtcaaagttaaaaacttgaagatcacttcaacatcactaagggggcgatgtttttagtgatgtttttagcaacgaaggaagcaataaaaattatacaagtatcattttattgtgacattttcactaaacagtatctaccaccatactgaaaataaaatattgattgttgaattttaattgtagtcaacatcacatagggggtacttttaatataatatagtacgagtgaactttgaaaactgaatcggtttcatgaaatttttcactgctgtatcagttttaactgtattttgattgtagtcaacaccactgtcattttaaaaaacttccagtggtaaaatagattaagtaaatttcaataatgaaattaaaaatcagattcagttgtattttcatttctttcatttttcgtggtaatttaattgcattcaacatagcgctgagggtaattttttgttcattatccgaagactcaacttgtcactcatgtcttttaagattctgaccattaactatttttttttcaaaaacagaaggtcacggatttgcaaatactttggcttcagtctcaaaatactaaggtggcctagtactagaaatttcaacaaacctgttgcagtactcattaagattcaaaatttccaaacttcatgctacaccctgtacaagaaaataagcatatttaaattatggaaatgatcgagaacacaaaaattcatgtttaaggaacaagggaactaggaaagattttcattctaacgtagtcatccaaaatagacctcaaactatcaatagtaggctttggaaatgttaaactaaagcccaactgcttcagttttcctccgtctaacctcagatgcttgtgcaggagaagctcagaatccatgtggggagacagaggggtattatcgatgccgtttcttcggcaactctctgcccaaggagtcaagtgtttgtcattagcatcatctgctgcgcccactagatcaaccacagctgatactaagtttccatagtagtcaattttcaagttgaatagctctgataagatgctagagatcgagccctgagtggaatctgcgtcgtcaacaacgttgtagacctgtccgtttgtatcgtccctgtttcctacaaaccagatggctctgcaaacatcttctacgtggacagtattgattttaagttcagcattccataaaagcttcatggtttctcccatgtgcttgtagatggcagcagccatcagtctcggcattaggcctgttctgtccccaggtccatataccacaggcagtctgatgatggtatagcataactctgacaagtcagccagctttttctctacctgtcttttccatttggcgatataagtccagggctccaccgggccatcctctttgtgacggaccttctcagatgaaaacatattacctgatgataattcgacgtaatgcttgactcgttgcatagaagcctcgttggcacagttgatactaagtttaagaataccttcattgtagacggggtcagtctggccagacttcgtttcccctgcgcaattgactacgatgtcccaaggggttccatcaggagaatgaaaagcgtttttacacgattctgcattgataagattggcgctcttgaattcgacgattttgctgttgaaagcttctgcatgtgtagaattgagccatgccacttgagggggaactttgtctaccacccttattgcactaacgagatcattgttgactaagtaggaaaccaaattgcggccaatgaaaccacaaccacccaaaattaaaactcttggcttggacattttgtatgaattaaatgtaagtacttcgactatcaattatcaccggatgttaagttttgaattcgcttgaggttttgataatgttatctaccacaaaattcacagaaatttctcaactc

SEQ ID NO: 85 - DNA, 2611 bp, Leptinotarsa decemlineata
  Annotation=Mediator of RNA polymerase II transcription subunit 21; Tribolium gene name from OrthoDB database=TC014894; Blast E- value Tribolium Gene vs. Leptinotarsa Unigene=7E-57
acagacaatttattttctaggttgaagtagttcaaaggaaataagacaaacaaaaacagcagaactaataaaaggaaaaaacgtaaaaacaaagaaaatcaaaggaagttcttttggagcgtttgatattttgtatattagtatagtaacaaaatggctgataggcttactcagttacaggactgcatcaataagcaagcagaacatttttgtaatagtattgggattcttcagcagtctgctcctcctagtaagttcccaaatttcgatagaagtggatcccagactcctcagcaacaacaaaatcaagaggactatgttcaattattcacaacattgatatcaagatgtgcaaaagacattgacacacttattgaatcactgcctagcgaagaaagctctacagagttacagcatgcaagtttacgaattttggaacaagaaaaccaagaagcagcagagaggttagaagctgttgtacaaaatgggcaacagctgctagaaaggatacaagctgcattaagtgatattgctcaagctcaacttgatatgcaacacctatcgaaaattgctacaggcggaagagaataaatggctacaatcactacaaatatttctgttttcattttacacttgatatcactgtttaatcatttggacatagattaaaaaatcaaagattggtaggaaccttattgttcaggacaaaattgttggcgtcagatgaagacattcttgttatataagtgatgtagtaggtaagagtcataatcaaatgtgtatcttgataattacctgaaagtcaaacactgattatccatagtctaagatgagtgaatctagaaatgttatgaaaataacagccagtgtccttttgatttacacatgatttttagagtagtaatgaaattaatttaagtcagtttgataaaaaatttaaatcagaaaggtgacatattctgggggtacgtacatataacatattatacagtgtgcgtcagtcacattgaatttctattgaaagttctcaaaaattatttcatataaaggttttgaaatatcttataatatacatggtaccgagtagaagcgtgtcctataaaattcagttttatttaatgtaataagatgttgctctcccccatttggatagcattttttcgatactgagataattgattttttctaatggaacactcaatatttcattcaagacgtaatttctccttggaaagctttttaggtataggtaaataagtagtagttagacagttataacaaaaatagtttcaagaaatatattattttcaacattgaacttcttcagcaaaaaactcgaaaatcaaatctcaggatgaaataaattagatacagactatcaataggtcttctggtgatcaataaatcatcaatcaaatcatgctaaaaatgtattttgtgtttgtttgttaaactctctagaaccactaggtatatacactcatgaaaatgcatattttcaaacagctttttgcaatgaaatcaaatgttgaataagatatatgttgttccatttataaaaatcaaaaaaaaaattgttttcaaattttgattcacctagaaaaatagttttaggtcaaattatcaatagatcaaacaattttataatgaaacagacttttcaaatgactttttaatgaatataggatggttgaacaaatcatctttgtaacatattttgcataacttctgagcttgtgtaaatttttgactattcagaggcagtttactcttctacgtgtaacttctcttgtttttttttcatggtgcattcattgtttgcatataaaggctcagaagtgacaaacgtccgtatcttacttctgccagacgttcattctgtgtgaatcagaacttagatttggatttgtcatgagcatttttcaaaccattctatttgtttgaaaaatctgggtctctgtatgtctccgtcagacatttcatcaaattcatgaatggcaaccttttatccatgacaattgctaccaaaccaaataaaacggggtctactagtaccatttataatgatctactcttctgtattcaaacttctgacgaataagaatatctcattccgtacaccatacttttattggatactttgtatattgtagaatattttgagagcccaatgaatttgtatctaaaaaaaaactttcataaggaatatttttagtaactacacttcttcatctcgaatttgaagtgacacatactgtatattatttcaccatgtgaaaatagtaccattataattaaccttgatgtttcttcactgctgcctgagaaataactcaaaaaatcaggattaaaaattatacagaatctattgaaactttgaaaggcattcaataagtgaattatgtagacgtagacaatatttttggtgattttaaatatttgctttgcgaatttgcctttattcatggtagtgtattattgtagaacagggtatcttgatgtaggtttttgatggtccattggtgattgacttcttggcaggaaactcttaacctattctgcatttttgtaagactgtgtttttggtattgaaataaatatttagtttttt

SEQ ID NO: 86 - DNA, 4578 bp, Leptinotarsa decemlineata
  Annotation=Ras small monomeric GTPase Rab6; Tribolium gene name from OrthoDB database=TC001600; Blast E-value Tribolium Gene vs. Leptinotarsa Unigene=3E-136
ggggatgatttgatttacgttcatgggttggtgattgcgtgtcaaatttgacgtgaacgtaaaaaatattggattgaaaaaatgaaatattaaactaaaattaatcgtatatgagcatatatctgggcctttttgagccgtattgaacgtttttgcattgaagtattcattgactcattaaatgccattaaaaaatgtgatgaacagatactcccaggatattaaggccattgtctgaatattaagcagatcaaacaagaaagctaaattcacattgtgattagggagttcaggagatttttgctcagactgacgtgcatgcaatattttcatcgaaaactaattatatttagaaaaatcgtcttttgaaggaactacaaaagttaatctataaaaaatgtcaacatctggagatttcggcaatcctcttaggaagtttaaattagtatttctaggagaacaaagcgtaggcaaaacgtctctaataaccagattcatgtatgacagcttcgataatacttaccaagcaactataggtattgattttttatcgaagacaatgtatcttgaagacagaacggttagattgcagctctgggatactgcaggacaggaacgtttcaggtccctcataccttcttacattcgggactccactgttgctgtggtagtctatgatatcactaatgccaattcctttcaccagacatccaagtggattgatgacgtgagaactgagagaggcagcgatgtgataataatgctggttggaaacaaaactgacttgtccgataaacgacaagttagtacggaagaaggtgagaggaaagctaaagaactgaatgtaatgtttattgaaactagcgcgaaagctggatataatgtgaagcagctattcagaagagttgcggccgctttgcctggtatggattctacggaaaataaaccaccagaagatatgcaagaagtcgtcttgaaagacacaccgaatgagctcaaagatccagatggaggctgtgcgtgttgatcaaattatacaatgttatctgtttctgtgcttgatcagcatagataccgacttcgtaaaggtactggcttgatttattgaagaatggaactctgtagctcttgaactgttatctccctttttgttaattttgctttgttgtaactcattctatttggatttcagtttagagaatgagacatccataatttagagatggtatctaggtagggttttctactgtgacaataataacatagactagcctcacatttgaaataatacttgattctaatagtcaaatattggataatataatttaacgctaattctgaaagaatatgtccattcttggaaactgatagtagacataatcaattttttaggtgatgttcatcaaataaaaagttttgagctatagaatgtttcataatctgcttttctgtttttcaaacaatttaaaaattgtgaaatgcatattaccgatctcaattgatttcaaaacgtaatttatatttcttttgccatcttgcatttgttcttggtttatatgaggtaagatatatttttatttcatgtcgagtgaattcaatactcgctttgatattattcatgaattagtgaatctttccaaaaaatgtattctccatataagtttaaaaatattccagctgtgcaattttaattaccttttcacttctagacctaaggtgtaaaattattcatttttgagtttaatttttctaattcgttttgaaaataatgaaactttaaaaatcaacaatatatttatgcattttgcattttttgataatgaactgtgggtatgatataaccaatatttgaaagtcggcatctatgtttcattattttctagattatttaaataactttttgcctctacaagttatgtaaattatataatttcgtattaatagttctataagtctatataatttttatcttctaatttattttgcgttatatgaatcagaaccgcttactgaaggtgttaagaaaaaaatgtgtacactatcaacttgagtattgtgcaggaaaagaccttttttatgtttaacctaaacttagattaatcattctaataaaatatagattttgttaacagctttcagaaatgtattatatataatcctgaaagttggcagcattgatgtttgttgtttgcaatttttatcaggcttcacaagacttaacagcagtccgtatattgggagtttatattatcataaaaaaaattgttttttcatataccttttgaaaaataatattttcagagtgactgtgataatcccattattgaaaattttttgaattaaaatcaaaataactgaacacaaatcaccaagtgatgtgcaattttcattttcagagaaagtatcttttccttcacaagaatttcactgcttgtgtagtgcaaaagaaagattaccaaaatactgtatgcttaatataggccaatattattgtgcttgatcatctatgttgacacaatggtgttttataaagcaatatttttttagttggtggcatacgggtttgtgaaatattaacattgcaggaattataagctgtcttctctttagtatttaaacatttcaaatgattgagtttactactacttgtattcaacgctagaattgtttcaataattcctaatatattaaacactgaacaggtaaaatcacttatttttattcaattctaaatatattattttttgagattcatacattttttccagaacagatgatcggatttatcacttatgactaaacttactgaaagaaaacaaataaaaaatttagtaaagatacgaatcagttggaaattgggaatgcaatataaaaagttttgatatatcaaaataatcatattgaattattaaaaaatatatcaaaaacttcctggaatatgaacaatgataactataaaatagaaacagtattacacaacaaatctacattcaccacaaatctacatttagtagtacttaaagtaaatatttcaattacactcaaaacaattggcattggagttcctgctgaacgtgatgtatgaacaaaaaaactttaccaccacttttattttaccgaagatgaaggtaacctagtcattgtacccaccttgtaaaacaatcgttaagcgagaagacgccgactggagagcaaatgcaatgagctctacatgagagtgatccattgctgttcccaacttggactccgagtattattgaataaactctagccatagactagacagactagtttaaattcatgatcactccacaacaaaagtcattctaggggatttgagttggagtatacatattgtttttcgacaaggagataatttcagatctggaaggcctgtcggctgagttcacagttggatttgaatgaagaaagtggtgaattcaaaagaacagtatccattctgtctgaaacaggatactatctgactgggttgatgaggcaggttcttgacctcatgtttgatcaatttttcccagtttttggaattcatatattttttctagaactatcgatcaggcttattactaatgtccaaacctactcaagaaaaacacaaaaattcagtaaagatacaaatcaattcaaaaatctagaatatgaacagtaataacatttatttactaaactttgcttcaacaattagttctgttcaaaaattttggagtataattagcgaattaatggagatatgatctcaaccatgtgtttttggcttcttgtatatgatattttcattccatttactgaagactaaagcaatttacaagagtccaacttgttcttttcaaattgattttacctccctaattagaaaaaaaataatttcgtaatgttaattaccgattccgaaaatgccatgattataatttaattttttaattgatgaagaaacactggcagatcttttaaaagggtatggtagtaacaaaatggcgagagcttctttttgttgcttgatgtaatcaggtgcaaaatttcaaaattatgaaagttatcatttgcctttataacgacaagcttgttatttatatcattactgaaaactacgctagtcattttgcacctgaatgtgtgtatgtggtcattaagattctggaaatgggcttacaaaattgacctgcgaattgtgtggtgaagtaactcttgttttatatcagacctgcaaatctggataaggagcaccactgtcttgatacatattttcaacagtttactgggttgaaaaataaacatttgtttattgaactttttttttacttgtgataattttacagtattctaaacactaaaaaaattgtattgcggcaaattatatattgtatgattgaactttgaaatccattatttatttgcctggagtagactgaaaaacaattacaggtctttgtcactcaggtcacttggtatattggtacgtcatgaacatgtttcttttatgactacagatgcacaagggacactctcgcactaactgaatatgtgacttaaatgttaacgaaaataaaaatttaattaaaa

SEQ ID NO: 87 - DNA, 2350 bp, Leptinotarsa decemlineata
  Annotation=Uncharacterized aarF domain-containing protein kinase 4; Tribolium gene name from OrthoDB database=TC007376; Blast E-value Tribolium Gene vs. Leptinotarsa Unigene=0
gatagaaaattgtgtcgatgacgtctaagaagcagttcaaactcaatcggatgttggatagttggttgtcaactcgaatgcaaaggaaaccagtcttgagtgaaattgaaaataatctatatattcttatgtcccaatcagtaattttgaaattccactttgagaataaatattgttttatattctacttcaggacattaggtgactttcataaaacacattttattaataacttgtctcatgttgaaggacgataaataacggccccaaaggttgaaattctttcctagtatattcttatgtgtgaaaaggtatgtaccaagtggaaaaagtacttcctaacacttctgtgaagtaacagcttatagcaatgtctcgagctcatgatgtggcatgcttgttaaggtctttacaactaatagctgaagcgggtgtgaaattacaagaggaaaatttaaagtacatatggaaagtctccagcattcgcccatttgtggaaaattgttctgtatgcaaaacccttccaaaaggaagttcaaaaactgtattagaaattggaggtgcagcaaaagacagtattgaacgagtagcaaccgttttacatgggttgaatgcatataaaaatgtggccttgaaaagagattcttttgcaacaccctccaaaaccaaggaaaactcgagaagttcatcaaaaactgataaaatagaataccaacagtcaaataccgaaaaactcaatagtcatcctattcacaaattccaaataaaattaacaaaaagtgacgaagaattattgagaaaacttgatatggagcatcgcgcaaagctaatcaaagcgggtgatagaaacaaagaagatgatgcagaagtgaaaactgtagacaataataaaaaaatggaagcagtgcctaatgagaaagctaaacaaaagttgtcacaagatgctaagcaaagaacagttccttcatcaagaataggaaggatgtactcatttgggacccttgctgctggcttgggactggggactgccacggaatatgcaaaaaggacacttggccttggggagtcctctccggacagtactaatttatttatgagcaaagctaatatggacagaatagtagatacattgtgcaaggtcagaggggcagctctgaaattgggtcagattttgagtatacaggatgaatccgttgtaaatccagacttggcaaaagctctggaaagagtgaggaaatcggcggattttatgcccaactggcaagtggaacaggtgatgagttctgagctgggacctgactggatgaaacatttccaagagtttgaacagagaccatttgcagctgcttcaataggacaagttcatcatgccaaattgaaaaacgaaagagatgttgccataaaaatacagtatcctggtgtagcaaaaggtatcgagagtgacatcaacaatcttggaggcataatgaaaatgtggaacgtgtttcctaaaggaatgtttttggataacttgatgacagttgctaagagggagctggcttgggaagttgattatatcagagaggctgaatgcacaaagaagtttaagggtatattagagccttatcaggattattacgttccagaagttgtggatcacttatgtaccaaacaggttttcacaacagaattattggacggcattcctattgaccagtgctttgatctggacctggaacatcgagaattcattggaaataaaatcatggacctcattctcctggaaatattgaaattcagatatatgcagacggatccaaattgggcgaattttttgtataatccttccaagaaacagcttctcttattagattttggtgccaccagagaatactccatagagttcatggagaagtacattcgaattttaaaagctgcctgtgactcagacagggctactgtccttaatgtttccagggaaatgggttttctaacaggatatgaaagcaagatcatggaagatgcccatgtagatgcagtaatgattctgggcgaaatattgagtaccgatggaaaatatgactttgccaaccaagatatgacaatcagaatgcagcatcttgctcagataatgataacacatcgtttatgcccacctcctgaggaggtatattctttgcacagaaaactatctggagtgtttttactttgcagcaaacttaaaatacaaatggcttgtaaagaaaaatttttgagattgtacaatgattatattgcagagactaggtgaaaaagaactctcattatttgaaatctcttttgtgtctattgtgttttggtgttgtgaaagtatttttattaaaaatgtttt

SEQ ID NO: 88 - DNA, 4180 bp, Leptinotarsa decemlineata
  Annotation=Phosphatase 2C gamma; Tribolium gene name from OrthoDB database=TC005701; Blast E-value Tribolium Gene vs. Leptinotarsa Unigene=6E-54
cttcattggggcgtgttgtatggatatggagaccagcgtcactatcagcgccctctatacactcgcaacgcaacttttcagcggtttcctggcgacaaacataccgtggtggcttacgtggatgcgatatttgtcgatggtccattatgcttatcagaacatgcagattgttgaattcggagaaggaatggaaatcaagtgcggatcccaatccaagttcgaaatatgttcaaaaggtgccgaaaccataccagtgagtgccatactagaggctcagggatcatatcttccgctgtgggcaaacactctcattctgttgtgcttcttcgtcgtcctgcgtgtcagtggttacgctgttcttcgttacttgaagacggcaaagtgaccctagatcaatgttcgtatctgcaaattgtgataaattcaatagatattagtcgtatcgacataaatcaaaagtttagcgatgttatttcataagatgttgtctatttaaatcaaatatccaaaaatcttcgacgttaatcaacttttgctgtgattttgtaaatatcccgatttggttgcacaatttgatccgtacaaaggctggtttatcagttgttttcatagtaatttttattggataatccataagaaaaatgacacctactacttctataattaataatcgttcattttatgtttaactggcccacatgactttatatttcaattttccaggtgtacaaaacatttgtcaactccatgaaataccttgccaagctgcaatttttgttttttaggttgaaatgaaatttgttttcgtagaacacatatgaaacaaagagttttgaaacgtgtaacacatttacaaatataagtttgaaaaatataacccaactatgggtacaatgaaccaaaaataggcaagttaggtgcttatgtctatgtcgttttacagaccaagtaacaagttaagaagagaatgacgtcatttttggtaattttgtatatccaatataacaacgttgaaattcccaatgaaatgcgttcagtagcaatgaaactggtaaaatttcattttgccagttgctcaacagctaaatttcagacgttgccgaatagagaaaaattcgaaaactgtcagtctttcttttcttttcagaactattaatttcttttgatatgacctgcgtatcttcaatatgcctaaagcattgtcgaaacagtctcaacaaagttgtattccaactgagtaagttaatagtaaggtgaatagcaacaaaacaaataaacggaaattaatataaatgctttatagacaattataccaacataaaactaaactaataaaaaaatacacatatatgatacaacagaaccaccacaattttgtttaactgaaggcacctctaccatgacttgctagacttagtgaaaatagtttatcacttcaacttgaattatttagagaccttcatgtttgtaaattgtatttttgtgtatgcaacagttccaattaaatcatacagagctcaaaaaagtataaaaattgtagtgatctaaacaaaaattataaattctgttcttagggatccaccctaaaataataagtgtcggcaattttattcatgcaagaaaacagagtaaatatacctaacttctttcatattttcctctaaatgttgaaaactattctattcgttcattttgaattccaaatcattgagcaaccttaaataatatttgaatgaatattaggaattttattgaattccaaattggtatttaatgagttttatttcaaaaattattgtggctcttctatgccttcgtgaaaaacatttcttcaaaagagattctccgacttcaagtgttaaataaatgataacctatattagaaatgaagattcaattttaatgagacaactggaacgaataaaactgagcatagaaagttaggtatcaagaagaacaattacaattgttatcggtaagtatatcatatggaaacaataaacctttttcagtaagacgcaaatctttgaatcgaactcactcagattctatcaatgaagtgattcttcattgttggatcctataggatactctttcgatttaaaaagaaaactttactcgtggaaaacactcaaagtaaactgattctggaaacatatttttacaaaactgacaataagatttacatactgttatttaacctatactatccaacacatttttgaaaatgtcacactgttgattcgatgtgtactttttcttcagtcttcgccctttttgaatccgtattggaggtttcgggaggggcagatctcttacaaatgtttgatttgaactgtactattatcgctgtcatgttatcacaaccggtcccatcaccaaatgtgttgggggccaaacaatggtcaaacatctcctcacaaattttagacaatttatcacaagtatttattcttggtctgacaaaatcaacgacctcttggctggacatgaaattccagataccatcacaggcaagaaccatgaattcgtcttctttgggattaactgtaagtgtcttgatatctggcaaagaagtaatcatctgttctctatccgacagttctttattttgtttgtaagaatgatctccgattgctctagaaagattcaaacctccattgactcgtccctcccaattcaccttaccaccagctttttctattctttggcgctctatatcatcttccggtttgtgatcaaggctcatttctattgcctttccatttcgacaaacaatacatctggaatctccggcattagccacatataactcattttctctaagaactgccacaactgcagtacatccactatcagatccaggtttctcaaaaccatcccctaaagccacatcttgttcatcttcatcgtcttcatcttcttcttcatcacagtcttcctcatcttcctcttcctcagagctaccatcttcttctgaatcttccatctcaatagccacattcacaccttcatcttcatcatcagaactttctacatttggcccctcaaaagttttgtcatcatcttcagtttcatcatcctcactgtcttgcccaaaattcaataacgccttatataattgattagcgtttcgtttaggtctcactatggcaggtgtttttggggtttatttttaggaatagcctttcctttgcctttactggtaacatctccattttcttgtggagcagagctagtgggatcagcgttcgacttttcatccgagatttctccattttgcggtgattcagatttattatcgttctttggtgtctcagtagttgtgtcactctcttcggtaccaagattttccggcgacgagaccttaatttgagggactgcaccatttggttctgatttttcaggttcatctttaacctctgatgagacagttccttcaacagtttcaagattagagctgctaccactcgaatcctgggattttgatgtttctttattttcagattggctacttgatgtggcagaacatgaggcctcatcagacgacgtatctttttttgcctttagaaagggtgatttcaggaattccccttttttcaaattttttaaagctgggtttgctaaattggtatacttttcaatcacttgctctattggcattgcagcttcttcatacaagttatcaatattttcttcatcatcactaccgtcatcattcagattctccccagctaactttgttaatgtttctataacttctggggaagtaatggtttgatcaaatcccagaaacccatcaatcaaggcacgctccaagtcattttctttataagcagatgtgtctttaatatattgaggtaacttttctgaacaatactgggcaacctcatggcccccatgtccatcatacacagcaaaaaatgaagtacttttgtcgaagtctagtacgcaattatgagcatcctcttggttgacacgccaaccctgcatagaactggcgccataactaagtcgatcatttgatgcatcgtccgacaatttctcggtcactggttttgataaaaaagaacaacccatttttaaattcttgaaataaactgaaagaataaaaattgttttcaatactgccggtattgaatcaaaagcgacttgttaactcacgtccatgctgcaagtc

SEQ ID NO: 89 - DNA, 1448 bp, Leptinotarsa decemlineata
  Annotation=Acidic fibroblast growth factor intracellular- binding protein, putative; Tribolium gene name from OrthoDB database=TC006041; Blast E-value Tribolium Gene vs. Leptinotarsa Unigene=9E-131
gatatgaatgttgacgttgacagatgagttacagtagaatgcttgtggataagtctgaattgatatattttagaattgaagatatgtttgaatttaaattatagaagaggcgttattgtttgatgtgcaatatttaaacatgacggaagtagatgtgtttattagtaactatactgtggtagatccagaaatttaccaactgtgggttgatggatatactggtttgacaatatcttttaacattaggtttgaaagtaccttttcattcttctagccagtgaagcagtgaatatactaaatggcaaaggtcttggccaacaaactggtgcctcgattgagctaattgccagtgatgtcttggatcactatcgtacatattccttactcgaaaaactgctaagttatcccaataagttacaagagcagtttgtcttacaaattgattcccagaccagttcattactcgttgaaaagttgtggatccattagtatttggcgaaaagtttatattttattttcagatactatgaatttgatgatgaggttattcgggagatactgggtaaaaaattgtcttcaaaaaatagaaaagatttggatgaggtggccgaaaagacaggaaaacctttgaaatcatgcaggcgacaatttgataatgttaaaaaaatattcaaaagtgtagaggaggttcctggatctactgttgaaaatgttaaaaattcatttcaattgagtgatgagcttgcaaagaaatactcttgtattgtgtttgtagcttgcatgagatttgaaacatctaaaaagaagcttcagcatatgtcgttcaatgattttcgaatatgttgtgaatctataatggaacattggacatataatttagcaggtacagaatataatgatttagaaatggatagagaattcttatttgaactaagagaacttaaagcgctcttggataaagatagagagcataaacatttattaatggtgaatttgaaacctaaattgttacagaaaaactttcttgatctggatatgaattttaagctgtatactagaacattattgactttagctactactcttcatagatccagggatatgaaggacttgttcgttgatttggctcaaatttcagaatatttcaaacaaggaaattggaccaaccatgattttgaacagttccttttagcttatggtcactgtgcaaatgaagttgaacctttaaggagtaattcggcattgaaatttagctgggaaaagtttatgaaagttattacaaagtgtttattagtaatatataattaaaacgttttgaaatgtcttcatattagaatgtaaataaaaacagtgtagcatatgattttctaaacccttaatattttttgaataataaatgttgaagtagaaaaaaaaaaaaaaaaaaaaaagtaaaactactagacgtt

SEQ ID NO: 90 - DNA, 4910 bp, Leptinotarsa decemlineata
  Annotation=Sorting nexin 9; Tribolium gene name from OrthoDB database=TC008241; Blast E-value Tribolium Gene vs. Leptinotarsa Unigene=0
ctagttttttgtatttattattgtataagtggtaataaaatatacaagttcacaattaacaaaatgtacattattcattttatatattatatactatagtaataaattcaatacatgcaaaattaaagatatacaaaggatatgttcaattagaatatcgtacacgaatcacatcaaaggtagcgatggtaaaacaaaaactattcgttttttctcaggcaaaaataatgttcataaaaaccgcgatataacaaaaaagcagaatctccaatcattcaatataagtgagtggcaattaaacaacactttcaaaacatctggaattactgtgtaattcttttattgcattaaaatttataacagtcactattactaacatagttacacaccaatgtgaggctatttttgaaagttcagtcttaacctcaggcaacagagctaaacaaagaaataaatcaaaagcggagctctgttattaacttgcacagcatcaatgttttgttaggattaaggatagcaactacgagctattcaacctatcagatgtctgtgtgagatatttctttctcatatgggaagcagtttcaatgtggaatatgcgagaattcctataaatttaaatggaattgatgaatcatgaaaaagttcatagtggcaacagtgttcgtgtaagaacaccagatgagaaggacctcaagatctcggtgaccgttgttttattatttacgaagaacttgacacagaacatgaagattttactaaggtaggttgcaagaaatgtgtcaggaattagtagtacagaggacttctccagctccaaaagacgtatgaagtaattgaagttaggttaattgttgacgcttcacgactggaaatcaaaatacaccaggaaacaattcagataaagaataagtctccagaacttcacgcttttatcatccaggcaagttttagctaatttcacgtcttctgaggaatttcaatccggcgcccaacatggggcgccgaacaacgaaattattgatccttccacagaagtcatttgtatctcaaataactagtttattgaagatatcattgactcaaagtttatgataggattgagctacggaaatattgccagatgtgattggaaaaaaaaatcattcatgaaagcagatgtgattggaaaatgccttgtattgcaaaaaattccaaaacacttataacacctaacggaagtaaagtggaaactttacttagttcgattctcaagacgtttccatcataacttcacaaacagttttgttccgtctcccctatttccaaatccacttcaacatgttcggcacgttattcaaaaataacttcaccaacaaaagtttctatggaatacttgtcatcatatttacactcgaatgtttgcgactatcacatttactatgcttacacttggaaaattaacgatgaaaagtatattggtcaaacttggtggacttctgaaggacgtttcaaacaagacctacataagtcaccaaagactttaaaattacagaaatcttttgccatcgccaaaaaatcaaggacatcgaccaccgttcttgctaccctgtgactttccatgacacatcaaggtgagactatatctgcctcgatagctcatgatcactttcatttgtttatttgtctatctaccaattatcactatgtctttgtaatgtttcaattaaatggagtgaatagggaaattatatacaagagatgggggcaggaagtgaggatactaacatctaaacaggataactttgtacatttttggtaggtcgagaaaattttgagaagattatcagtgatccaggtcaatttatagttgaaagaggtttcagttgtcgacagtgaacaagaagtgcaacagaaatcgatttgaaaaaccctcacccagttggtgtcttcgtctcctgaaaccaactgtttgtagttaatttttttctgccgcccaacgtggggcactttcgataaagcaaaaaattattcatgctttaatcaaacatcttcggccaagagccattgtaggagttttcagaattttatggtttcattaaatttcacaaccaatcaggtgacactgtgataatataaagatgaatatgaagtaaagtttgaacgacgaacataaatttaataaaaatgtttatgtatttatttgaatttgactgaatattcgaaggataatataatttgctgttagatcattcaagtaaatctgcattcagatagctttgcatcaatatttgaaaaaaaaatgttcatcacatgaaatgaaaaaactcgaatgaaaaaaaagaaaaagtgacagtttctaattgtgttttgaactacttcaaaattttttatattttcaatctcttccattcaacaaatttgtttcgattttttcatcagtattttatataacttccacatctcaaagaaagtccttaccctcgaacttcaacaagataatagttacattcaaatgaaactaactcccacattcaaaaattccacttctgatggcgcccaacgaagtatccactgaatatgtcggacatttaacaccgcaagattggattgagataattcaaaatccattgaaaacatgtcatgcaggaaaggatattttttccaatttaggataaaatattgtgatgataagggatatcaagggagaccgctcggaaattcgtctggtccacaggcgatttcaatttgtgtagagaaaacacctttgcttaactcgatctcaagacttctgggcctgatagacaccaatacctcaacatatataggaaaatctgatttccaattcagaatcttctttggtaatatgaagtatgtgtttgctacgaacggtatcaaactacagaaccagttcacagcagttttgttgccgcaccgttccaaataactgaaattcaaattatagttcatgatcaccgaaaccctctccaatctctacgacaatcttgattattccggcgcccaacgtggggctgaactcacaaccgacccctttcttcggtacgctgccttaatcgaactgagctagcgtgtcctccagcttgcacactatattcttgtagaaattcaactgttccttgaggaacgtcttcatcgtcagccggagatcggtatctctttcgttctggaagtggtccagttccgcgaaaacagtgtacgtcagtacgtctgcgcgacgcctgacgtctcccagcgccacttgcgcgacttgcgagttccgctcgcactctttcttcttctgctcggagagcttctgcatgttgaggaggtcgggaaggctgctcgttatacctttgtagatgtagagcttgtcgaaaagtggttgccagtcgattttcgcttgttcctcgtacagtttgccgatcatcatgtaggtggagccgatgctcttcacgtcgacagacgccttcgagtacatcccctgctggttgaactcgaacgccgagcccaaagcgaaaaagctctcgcctatcctggagaactccctcttgtacatgttgctgcacttcttgtgctggtcctgcgccgtctgcatcaggttcttgaggcactggtccatcttgacgacgtacgcgaggttctcttcgatcttctgatccaccaacgaggagaggatctccttttcgggggcgtcgacgcacgtgcagaagttggcgcctaccagctggtctcgttcggcgttccgcttgccctgcttccattgcttctcgtcggtgcacgtgaggaagtggatccagacgtcgcacgtagagaggatcggatgtcggcacatgtagtcgatgaactcctgcagttgcgcgcggcggtgttcgatgaagtgctcctcgtagcggccggacacctgcttatccggcaagggaggaattgctatcacattaaatttagctgtcaacctatcgtgcaaccaatcaaaatgtttgtaccgcctggagacttcaacgttggagaaagaaggcgtcagctggtaggcgataaatgatttcagccctcccatcttggtagctttcttgggggaagctatctgcacggtataagggttggtgataacctcccatcttcctaagatgtcgtcaccctctctcgatattcgatactttttactgactggaaggttgttgaaagtacctaaaatatatccctccaaaccagatttcacgtacacagagaaaatattcaaactcttcttggtgacagtacctttaccatcgcccatggtactgctaccacccagcgatacattgtcgtgttgaacattactgccaccatagggaaatagattttgattcgtttcattattgtagagattctgcggctgctgattgttacttccaatctccgaatacattgtatcgtcatcccaatcatcctcatcatcccaatcgtctttctggttgggtggaacccgttccgtccactcgttttgtggcagaacgggggcaggtatgctaggggggttcgaaccgctcacccgctctacgtaggcttccgggaacagccctgactgccctctcgagttgatgccttcccaccatccctctccgacatcagtcctgctcactgtgagaatttccccagtggaaattgtcatttctgctgttcctgcttctccttggaaatcgtacagcaccttcactttgaacccggccatattttgcgggggtttcttatcaattgtgggtggaagtgaagtctcttgaacccctgagtttcctatcaggttattgtatatgaagtttgttttggttaatctcacgtttgtttacggatactggtaattttgttgggtttttcgatggtaaatattgtttcactgcacgaatattaacaattttcactttattttcgatgacaatacctctttaggatctgtc

SEQ ID NO: 91 - DNA, 9042 bp, Leptinotarsa decemlineata
  Annotation=Chitinase; Tribolium gene name from OrthoDB database= TC015481; Blast E-value Tribolium Gene vs. Leptinotarsa Unigene= 5E-169
gtggtttgtttggtcaggttttcaggtgttggtttttcgacttccagtggacacgtgcgggattttggagtttgtgactagaagagaatccaagtgtacttcttcagggagatagaaaaggatgagttcgagattttagtgtgaactgagtgattcgctatggaaatgtacataaagatatgtacagttcttcttctctgtacatccctaacagaagaaaaatcaactagagtaaaaagggatcgacacgctccccctttgaacgtaccaacgtttagaagagactccgtggaacacgtgcccgaagcagacagggacagaagttccccttatctcaaatatgaagaatttggaaccaaaagcctaccgttgagaacagccgttgagagtgttccagatttgtccatgaactccagaagactgcctcttcgagacgctgtggagaagaggcctcctccagatgaacctttggacccagaagaagttttctccccaactcaacagcaaactatcatcccctctggacagctagatttctcttcccagaatgactttcattctcagccatccgttccacaattcccttacaatcagtactttcccaatcaagttgccttcacccctttccagacgtttccacaaacctatttccagaagcaacagtctttgtattcgccgtttcaacattttcagaacgtcataacagattatagaagttcccgtccctacagggtggatgacagttatcaacagctattgccgcgaccttatggagctttggcgggtaggagtctgcgacttgacgattctttttttggaggaggtcaaaagaggagaaagaagagcgctgaagaagacgctaagaaggtagtatgctacgtgcaaggtacggcagcttacagaaaggaccctttgactttcaatgcagacgatatagatccctttatctgcactcacgttatttattcctacgccaccattgatcccatcactttcgaaatggtttccaacgatgaagcttacgatattgtgcaaggaggatatcgagcactaacaaccctgaagcagaagaacgccgacctcaaggttctcatttccctcggaggtagcagaggaggcggctcccaccgcttcagcacgatggtgtcaaatgcccggaagagaagaaacttcatccagtcagccatcaccttcttggaacaatatggcttcgacggtatggagctcaactggcaatatcctggagcggaagaattgggtggccaagtgagcgataaagagttcttcacagcgttcatagaagaggtttccgaggtgttcaagcagaaagggtggttgctgtctctttccgcgcccgcttcgaggttcagaatcgaagacggtttcgaaccgtccaaggtgggggaatttgttgacttcgtaagtgtgcaagcctacgattttcatacagatagagaacccgtcgcagaccaccataccaatctgtatgccagaccggaagacactggactcaatatatttttgagcgtggactattccgtacaatactggctgaggaaaggactaccaaggacgaaactggtgctgggcatccccttcttcggaagatctttcaccctccagtactccaatgaaacggacatcggcgccggcatcaaaggccctggtcgcgaaggtttctacacccaatcaccaggactgttggcctatttcgaaatctgcgacatgatcctgaacgaaggatggttcagaagccaggattcttcaggatcccccatcatcatcaacggggatcagtgggtgggatacgatgatgctgagagtatcaaaagaaaggttgactacgccaaagtaaacggacttggtggtatatctgtcgcagccgctgatatggatgacttcagaggcctttgtggtgaaaaatggccattgctgacagtggttaacagagaactcaaaggtgtcaatccaatcaatgaggaacagacacatccaaccaaacccatcggagtttgcgactctacaggctactacagcgactcaaaaaactgcgcagcttactacatttgcaaaaacggcctgacttaccatctctcctgcgggaacagtctcatgttcaacccgttgaatgggaaatgcgatcaagttaatccgcaaaactgccgacctggagaaacagtccacatccccagcacattgaaggatgtgaatttcctgatgaagaaggaggccatcaaagacaacaagcccaaagttgtttgttacgtcaccaactgggctttctatagaaaaggagaaggaaaattcgtaccggagcgtatagatcagcgcctttgcactcacgtggtttatgcttttgctagtttagatccagagaaactgctgataaaagaattcgatccctgggcagacctagacaacaatctatacgataggattacgtctctgaaagatacgactgtgcttctttctctgggcggttggaccgactcatctggcaacaagtattccagactcgttagcgacggaactgccagacgacgtttcgtcgttggagcagtcagtttcctacgcaaacatggcttcagaggtcttcacttcgattggaactaccccacctgctggcagagtgactgtaaaagaggaccttcctcggataaacctaatttttcgaaactcttgcaggaactgaaaaaagaattcgacaaggaaaatcccccgctagtcttagctgccgctatctcaggctacaaagaggttatcgacgtagcttatgaccttcccgcacttggccaaagtctggacttcatgtccgttatgacctacgactaccatggagcctgggaacgtcaaacgggccacgtcagtcctctgtatagtagccccgaagataagtacccccagtacaatgcgaacttcaccatggagtacttggtctcttcaggagccccacgcgaaaaacttctactgggtattcccttctacggacaaagcttctcgctgtcgaaaaagagcactttcagtgttggaacttctgctacaggacctggagaagcaggagagtacaccaaacagccaggaatgttggcttatttcgaaatctgcaacagagtgaagaatcagaaatggatcgtcaacaagaacagtccagcggctggtccttttgcctatggaagcgaccaatgggttggatacgaggatgtggactctgttaaaaagaaggcttcgtacatcaaatccaaaggcttcggaggtgctgtggcgtggaccattgacttggacgatttcaccaaccgctgttgcggtggagttttccccctcctcagtactattgcacgtgaattcggtctcatctccgataaacaagttcaaggagactgcacgaagccggaacaacctgttactcctcctccacttcaggctaccacaggctccgactcaggcgcagcagtgacctggtggacgaatccaacgacaaccagcaccaaggctcctacctctactgtttggtgggtaccagagagcacgactaccaagccaacgaagaagcctaccactaccaattggtggactgagacttcttctgtgaaacctccgacgaaaccttctactccttcgacaaccaattggtggacggatacctcttcttccaagccttctacgaaacctcctacaaagcccagttccagcacagttaactggtggacgtctactgtgaagtccacgactaagcctagtcctaccaccatcagttggtggacagaaacttcttcttcaaagccatctacgacaccgtctaagaagcctatcaccaccactccttggtgggctactaccaaatcaacaacaagaaagccaacttctacaccttcctcagtaacagagaagccaactaccattcccactccagcagttataatgccagaagtcgacgtccccacgaaaaagtgcactccaggggagtatttaccagacccagcgaactgtaacgctttctatcgatgcgtttcaggcgagctgcagaagcagtactgcgcaggtggactacattggaacaagaacagaagggtttgcgattggccgacagaagcaaagtgcaaacctgtgaaacctgcccaacagatgcgtcccatgaaaatgcctcttccacaaccatctccatggcaaaccaccacgatgaggtacaccaacacctggccaactcgtccgaccaggacaacgacaagaagaaccaccactgtaacgacacgcacaaccactgtctctagctccgggtacgtttctcaacctttggagcaggaatgtactaccggagcgtattacccacatggtgaatgcagctctttctacgtatgctttgacggtcaactgatagttcaaaaatgcgcacctgggctcagtttcaatgcgcagacgagaatatgcgattggagcttcaaagtgatgtgcaccggaagaaggaagatggctgaaaggtttactgctatccacgatagatatattggagaccgtccacagccctactcatcgtgcgaaggaaacacgtttgcaccattgccaggagattgtggacagtatatgcactgtcaatggggcaaatacgagataaggcaatgtgcgcctgggttacactggaacaatgagaagaaaatctgcgactggcccaaagcagctagatgttctgaagaaacagagacggacaacagcatagttgagatcgaagtcaagccagagcctcccagcgggccggtgtccgctccctgggaaccccctactacgtcgtaccctgaatggaaacccccgagcaccaccgaatcttcgggaaataactgggaatggcacccgccaattccgcctacgtctgagaagccaccgctctcagaacctctgaagcccttctcgggatacttcaaggttgtctgctacttcaccaactgggcttggtatagaaaaggtgctggaaagtatttaccggaggatattgatgagaacttgtgtactcacgtcgtttatgggttcgccgttttggactactcgaactacatcatcaaggcgcatgactcttgggcggatttcgataaccaattctacaaacgagtcaccgacttcaagtccaaaggaatcaaagtatcgatagctataggcggttggaacgactccctcggagataaatactccaagcttgtcaacaaccctgctgcacggcgaagattcatcgaacacgtcctcaaattcttggataaatacaactttgacgggctggacttggactgggaataccccaagtgttggcaggttgactgcaacaaagggcccgattccgataagcaagctttctcagatttcgtcactgaactcaaagaagcgttcagaccaaggggatatctgttgtcttccgcggtttctccaagcaagacggttattgatgctggatatgacgttccggttctcgccaagaatctcgactggattgctgtcatgacgtacgacttccacggtcagtgggataagaaaactggccatgttgctcctctatactaccatcctcaggatgaagtgacgtttttcaatgcgaacttttccatcaactactggatatcgcaaggcacccctagacgcaaaatcgtaatgggcatgcccctctacggtcagtccttccggctggaaaaggaatcggagaacggcctctacgccaatgctccaggtcctggtgaagctggtgaatacacccgagcagcgggtttcctctcctactacgaaatctgcgacaacatcaaaaacaaagggtggacggttgtacaagacccgctgggtgctataggtccttacgcgtacaaaggaaaccaatgggtgtctttcgacgacaaggagatgatccggaagaagtcagagtacatcaggaagatggacatcggtggtggaatgatctgggcgttggatttggacgatttcaaaaacagatgcggggaaggtagacaccccttgcttacgatcatcaggaacgtccttgcggacccgggaagcggtcaacaggagcccatagaagagcccaccaagcctgtggaaccggctgagcctttgcgtcccgaaattgaagaacctgagccggtagtagaaggagaaccaaccggtatggtggaccgcagctcagagttcaaggttgtttgctacttcaccaactgggcttggtatagacaaggcgtcgggaagtatgtgccatcggatattgaccctgatctgtgcacgcatattgtatacggcttcgccgttttgaatggggatcaactcgtcattaagccacatgacacctgggctgatttcgataacaagttttacgagaaggtaacagcgctcagagctaaaggaatcaaagtgttaatcgcaattggtggttggaacgactccgctggagataaatattcgaaactggtcaacagtccttctgctagaaggaggttcatagcccacgttgtcgatttcatagcagaacacaatttcgatggtttagatttggattgggagtatcccaagtgttggcaggtcgactgcggcaggggtcccgcctcagacaaaccagccttcgcagagtttgtgaaggaactacatgcagctttccaacctaaaggctggctactctcgtcggcggtttctccaagcaggcgagtcatagacgctggctacgacgttccagttctatccaaatacctggactggatagctgtgatgtgttacgactaccatggacaatgggacaaaattacgggacacgtagcgcccatgtacgaacacccagaggatattgacgataccttcaacacgaacttcacgattcattactggatagaaaaaggcgcggatagacgaaagctcgtcatgggcatgccgatgtacggacagtctttctcattggctgacaacgacaagaacggtttgaatgttgccacatatggaggaggtgaagctggtgaagaaacaagagctagaggattcttggcctactacgagatttgtagaaacgtcatcgagaaaggctggaaactggtaagagaccgtaagggccggatagggccctacgcttacttgagagaccagtgggtgtccttcgatgatataggcatgatcaggcacaaatccgagtatatcaaagccatgggtcttggaggagggatgatttgggctctcgatttggatgatttcaaaaatatctgcggttgcgaagaatacccgctgctcagaactataaacagggtgctcagggggtatgctgtaccagaaccaaagtgcattttaggtaaaccccaaagcgcgaaaccaccaacaaaaccagtcctagagtcatccccatcaaccctttcccccatcccacccactcatcctccaaccgtaactgaaccgtcacacaacccccccgagaagaaaccttgtgaaggtcgcctcttcgtgccgcacgaaaccgactgcaaccagtactacctctgcaaccaaggcgagctccaggtgcaatcttgcggcagcggactcttctggaacgtggaccactgcgattggccagaaaatgcccaatgccatccggacggtagtactcttgctcctgtggatgtcgccgcagaaagtaccgaggcacaagaacgacctgagactgccactgagagtgggtaccttcctccagtggagacgggggtcacgccttcgtatcctgggactgccagccaagaagaggacgggtacaaggtggtttgttacttcaccaactgggcttggtacaggcaaggcgatggaaaataccttccctcagatattgatccagaactctgcacgcatatcaactacggatttgcagttttggatggtacaacattaacaataaaaccgcatgattcttgggcagatattgataatgaattctacagaaaggttgtcgagttgaaatccaaaggaatcaaagtactgatcgctataggcggatggaacgactcactgggagacaaatattccagactcgtcaatgatcctcaagctagagccaggtttgtgaaacacgtcgtggaattcatagaaaaatggggatttgatggtctagacttggattgggaatatccaaaatgttggcaagtcgactgcaacagaggccccgattcggacaagcaaggttttgcagatctagtacgggaactaagcgaagcattccggcctagacgtctattgttatcttcagctgtttctccgagcaaagccgtcattgatgctggatacgacgttccgttgctcagtcgctactttgattggatagcaatcatgacgtacgacttccacggccactgggacaagcagactggccacgtagcacctttgtactactacccggaggacacttatgattacttcaacgctaatttctctatacactattggatagagaaaggggctcccccttcgaaactggtgatgggcatgccactgtatggtcagtcgttcagcctggcggatggaggcaaaagagggctcaacgaaaagtcttatggtcccggagaagcaggagagtttacaagggctggaggattcctagctttctatgaaatttgcgaaagagtgagacgtagaggatggacagttactagagatccagaaggtagaattggaccttacgccgttcatggaaatcagtgggtttcttatgatgacatttcagaaatcaggagaaagtcgaaactcgtgaaagattggggcctaggcgggggtatggtgtgggccctggacttggatgatttcagaaaccgctgtggctgtggtcgtcatcccttactgaaaactatgaacgcggaacttcggggtgttcaatctgatatatcactgcagaattgtacttaaaaaataaggatactgagagttgtgattattacatgtagaaggcgcgcatattgtgatgtcatactgatattatttcataagtgtatattttttcttctttggggcgttcatggtacgttccaaaggatacaaaaataattgtgaaacctatctggttgctgaataaagttaagg

SEQ ID NO: 92 - DNA, 3370 bp, Leptinotarsa decemlineata
  Annotation=MDM-like protein; Tribolium gene name from OrthoDB database=TC000503; Blast E-value Tribolium Gene vs. Leptinotarsa Unigene=7E-69
gatttcgtggaagtttatgaagcaagtttgtgcgggtttagtttacgcgtgattatttttctcaaaaattatttctagtcaaaatgtcagcaacagtagaaagaagcacatcctcatggagaaaaagatcccgggaaaacgatcagtcttcccaaatagataggaaaagaccaagatattattactatcgactggaaagtgaaagttcgaaagcttctgaggaagatactgaaagtgtatatagtttgcaagacagagaaactgacgtagtgagagatacatccgatactgattcaaaatcggaaagcagtgatcaacaggagttcgaactcatcgaatatgaagtggccagcttgtctggaagtgatgacggatgtcaagaaaattcgtcaagtggctctgatgaccatctaatgattgctgcagctgtggaagttttatgcgactcttcattggaaagatgggttacagattgtgaggactcggataacagttctttagatggttcagctatttctcgatcagacttttcaagatgtgttcagtgcaagtcggaaaatgacaaccctctctacagatattgtgaaaaatgcttccaggaccgtaaaagactgtttcctccacggccaagaggaaaccggaagacaagaaaaccgattgagaaaaagcaaagggatcctccagtgaaattagacacgttacgctcctgcctgagtggtttatcgcaggattccggtataggatcaagccaggattgcccatccttagatttggatcagatcattgtcccggacgaacatttacgaccaggtacgtcgaaaatatcacccataagtgaaaacggtgaagtcgacagaaagagttcttcgtcagccgtagcagatgagaaaatcataggagaagttactgtctcgaaaacgaatgttgatctaaagcgcaagaggcaggcatctgagagtagtttgtctgatttcgaaacttcaaaatcgaaacgtttcaaagagcaaccaatttcacttagtcagacttcagatttgggttccgaaattagcacaacttcattcagctcctccactaccgaaaaaagttcggaaaattccgagctatgcatcttttgtaataatgcccccaaagatagtatatttcttcatacaaatattgcacatcaatgctgttgttataaatgcgcgaaacgtaccctccacacgataaaaaggtgtcctatctgtaaccggtctgtaaataaggtagttagaatattcacttcgtaatagaaatagtaaagatttaatatatatattttttgaagatataataggtgtacagaagaaatttatttaatttattcaaatttagtgtgaattcatcacactatatgcgactgatgatacataaatttttatttttactgcttgtagtgtaataatataatcaaattattgttttcaaaactattgctgccacttttaaaaccactctaaccatatcctatggagatcaacggtttttcataaaagtaatgcattattgagatggtaatgataaggcttgatgcaaaaatacagcattattaataacactggtaaaattcctgaaaggtctaaattacaaaaagaaacatttgatgtataaacttatagcctttatggatatctacaaggcttttcataagttgttacaaagttcaaccttttgtgtttgaacttcaaggaaatattcaaattcaagaattcctacaagaggagtaacgaaactctctcaaatatccacaaagcatccatctaacttttgaatgaatgtttttttaagagtcattttcagtgtgttcggcaatcggccttgattgagagtgaatcctagtcatgttttattttggttgacctatcaattcagaatagagaatcttaaggatctctagcttgaataaacttttttttcaagttttatgttagtcattaagtgttcaaaatttctcgactcatttgaaagtttgatggtataaggagtttgttttccctgtgtgttatctgtgttagttgatgagttggattggaatcagtttgcagatttgatatgtttttcttcttttatcagtcagagtttaaagttaatgacattctgaacatcgctcttcagaaatttaagagtgattataaatctatcagtttttattaaatattttaccacagtttcaaagtcatagtgttcaaataagattgagtacaaagaaaacgttttatcatctgttatatgaatatgtaagattggaaaagtggtattcagacatatatgaagaaaactctttattcaaaaaatatgaagcaacggaactaaaactcaattcagtatatgtcagaatactactaatccaatcattcatataattaatggttcattgaatatttcaagcggtgatttatttttctttcaaaattcttaattatcttgatcaatttccggaagatcttcgcaaagaattactttcggtttaatactcccttagatatcgtgatcttttttcacgaaaaataaaatatctcgcaaagttttgacaattttaagattactcagtatgactttagtggagtagttaaggcaccactttatcaacagtcttgtagttgtacatgagtttgcaaagaagcaggagacccactgtccattttgaatctttggaaagttagtactcactgaggaaatctggatggtcctataataggtcccacatattccacagaaattgcaaacagttagttgattatattgttcatgagagcttagcgatcaaaaagactgaaccaaagaaattatattttactgtatgtaagtttgattatgaatgttttatgtgaattttgaaattagttctaaaaagctcttgtttcacactcttaaatttttgaaaagcttttctcgattttgaggatcttaaataatggtatcgaggtatattggggtatttaaactacaataacacaacgaagctaaatcttattgaagaggagattttttatgtaagagtttaaaactcgaatttatactttacaaataatgttacttcatgaaaactatatttattactcatgttatgattgaacatatattcaattaaaatttgaagtagtttttctaatatccttagaaacaatacaatttcgctatgctgactagaattttccattatgttgtacttcataatgtaattattctggtcctgtaatgttttgatgatatttagtgtatgacaatatttcaaaaaatatgttttcagttaagtttcaatgtgcaatgaaaaattaaattttctgtttattttttattctgaataaaactatatcctcaataaaccaaaaaaaaaaaaaaaaaaaaa

SEQ ID NO: 93 - DNA, 2421 bp, Leptinotarsa decemlineata
  Annotation=Glutaminyl-trna synthetase; Tribolium gene name from OrthoDB database=TC000042; Blast E-value Tribolium Gene vs. Leptinotarsa Unigene=0
attttaaaataaatattttattgatttctattttccagcatcctccttgagaccaactgttctgttgaaaacgagcttatcattgtttgtatcaggatccacagagaaaaaaccatttctctcaaattggaatttatcaaaaggacttgcttctttgagagacatgtctgaatagcttttcaaaataagtagagaattcgaattacaatcgctaatgaatcctcctggaacttcattcaaatcttcgggatttttatgtttgaaaagagaagtgtagagcctgacttctatctcttgcggacagctgacccaatggataaaggcttttggtttagatgctttgctgacttcaaggcacttacatacaacttcggttacttcacaaccttgctttattacctgggtcacttctaaaatgtatccagcatgacgtattccaacagattgtgtcgtagttaggcgacgatatgatttctctcctacctccataaaatcgcttttttcaatataaattgttctgtcaaacaccacagtatgactacccaactctggtttattgggataatttggtacatcaacactcacaggttcagcaaaaggaaagttttcaattgatatctttaaaggttctaagacaaccatacgcctaggagcggtattattcaggtaatccctaacatatgcctctaacatcgaggggtccactgtactttgggctccagttacaccaagttgggcgcagaaattgttaattgcttctggtggaaatccacgacgtcttagggctgttaaagtaaaaagccttgggtcatcccaatcattgacaattttttcttcaatcagtttagctatttttcgtttagatacaactgtataatttatattaagtcgcccatattcccattggacgggacagtaaatattcaaagcattacaaagccagtagtaacttgatcgccttgactgaaattctttggtgcacaatgaatgagttatattttcgatactatcacatagacaatgggtgtaatcataagttggatatatacaccacttattaccagtacgatgatgaggagtaaaccttactcggtaggctacaggatctagttttccttcctcaagtgtaattttcatccttagagttgctgcaccttcatcaattttaccatttttcatatcctgaaaaagttgaaggttttcttctataggacgttctctccaaggtgatggctggggattgaaacccttcatttcatcagcagtttgatgacaaacataagccaaacctttttctatcaattgtacagcccattggtataactgatcaaagtagtctgacgagtgagtaattttgaatggcgtataacctagccatgtaaccatatcttttatggcaatgaaaaatttctcttcttctttttcaggattcgtatcatcataacggagaaaacaaactccattatttgctgctgcatatccaaaatttatattgattgccttggcatggccaatatgtagaataccatttggttctggagggaacctagttcgaaccagtccactagtggttttcaaatgatccttcaataacttatgtgtgtactcagttaccacataaccttcggttttgtagttttctccaggagcatgaaaatttacttttttcattacgtcaagtattgtaagaccttgatcctcaatttcatttttttcttgaacaaaggatttgggtttgggttcatttctcacaggtttggaagatttcttctcactttttgatactggaaccagatctgcttcaatttttggaccaagtaaatcaaatacttgtaaatcaacttcactttttattgctttaccatctgcccaaggtaattcacttcttactttctgcatcagaggacctgtgttaaatcggtagcggttttttaacagttcatctctgttgacgactatttgtttctcaactgctttttcaatttcttctggtgtcacaacaactcctaccccacaaaatttctcaagctcgtcaatgttgatctcttttatatgcgaaagagcaaattcaattgctttgtctacacgaattgatgaatctaatttatttgaagagatgtactccactaaaagaggtaaatggtgagatatttggggttttattttagtccccaaatgatatagcagcgtcctagctccttgagagagttcaaaacaccctacttctctcaaaatactatttaggttcttggtaagggttacatttttcaatgtttcaatggacttttgtttgcttagacccaaactcatgaaagcatctatcgtttgctcctcgttttgagacatattctataaattacaagatttcgcaatccggcaataactataaccttccgtattccagaaatctaaccttacatt

SEQ ID NO: 94 - DNA, 7457 bp, Leptinotarsa decemlineata
  Annotation=Pre-mRNA-processing-splicing factor 8; Tribolium gene name from OrthoDB database=TC010565; Blast E-value Tribolium Gene vs. Leptinotarsa Unigene=0
agtacgacagcgtatttagtgtttgtgaggttatgttatactatacgtttcaacaaacggaaaaaggaagctttgctgttttcggtctttagatttgtaattattgaagtttgtatttgatagtattgttccaattatatattggtcaattaaattcacaaaaatgatttgaggacgacctacacaaattatacaaatgaagtgacacgatattgtgaaacttttgatgcactagtttcgagtgacaaagctattctatagcagatatgtctttacctccatatatattggggccaaacccctgggccacaatgatggcccaacaacacctggcggcggctcatgctcaagcacaagcagccgctgctcaggctcatgcacatgctttgcaacagcaaataccaccaccacatccaaagtctgatgttatgactgaagacaaactacaagaaaaagcccaaaaatggcatcaacttcagtcaaaaagatttgcggacaaaagaaagttgggatttgtcgaagcacagaaagaagacatgcccccagaacacataagaaaaattataagagatcacggagatatgagcagtcgcaaatacagacatgataagcgagtctatctaggggctctaaaatacatgccacatgctgtaatgaaactacttgagaatatgcctatgccatgggagcaaattagagatgttaaagttttataccatattactggtgccattacctttgtaaatgaaataccttgggttattgaaccagtgtacattgcgcaatggggaaccatgtggattatgatgagaagggaaaagagagatcgtagacatttcaagagaatgcgttttcctccttttgatgatgaagaacccccgctcgactatgctgataacgttttagatgtcgagccacttgaggctattcaaattgaactggatgcagaagaagattctgctattgcaaaatggttttatgatcataaacctctagtagggtcgaagtatgtaaacggacccacttatagaaaatggaaccttgctcttccaatgatggccactttatatcgtttagctaaccagttgctgacagatcttgttgatgaaaattatttttatttatttgacacaaagagcttttttacagcaaaggcattgaatatggctattcctggaggtcctaaatttgaaccactaataaaagacatgaatcctgcggatgaagactggaatgaatttaatgatatcaacaaaatcattataaggcagcctattcgtacggagtacagatagctttcccatatttgtacaataatatgccccattttgttcatctatcttggtatcatactccaaatgtggtttacataaaaactgaagatcccgatttacctgctttttactttgatcctttaattaatcctatttcgcaccgtcatgcagttaagagcttggaacctctacccgatgatgatgaggaatttattcttccagagactgtccatccatttatgcaagaaactcccttgtatactgataacacagctaatggaatagctctcttgtgggctcctcgaccattcaacatgagatcgggtcggtgcagacgggccatcgatgtccctcttgtcaaatcctggtacatggaacactgtccaccaggtcaacctgttaaagtgagagtcagctaccaaaaactgctcaagtattacgtgctgaatgccctcaaacaccgtccacccaaaccacagaagaagaggtacttgtttagatctttcaagtcgacaaagtttttccagaccaccaccctagattgggtggaagcaggcttgcaggtttgtagacagggttacaatatgctcaacctgctgattcacaggaagaatctcaattacctccatttagattacaattttaatttgaaaccagtgaagaccctgaccacaaaggagagaaagaagtctagattcggaaatgctttccacttatgcagggagatattgcgcttgaccaaactgataatagattcccacgtacagtatagattaaacaatgtggatgcctttcaattggctgatggattgcagtacattttcgctcatgtaggacaattgacaggaatgtacagatacaaatataaactcatgagacaaatacgtatgtgcaaggacttgaagcatctgatatattacagattcaatacgggtccagttggaaaaggaccgggttgtggaatttgggctccaggttggagagtatggttgttctttatgagaggaattactcctctcctggaaagatggttgggtaacttgctctcacgtcagttcgaagggcgtcattcgaagggtgttgctaaaacagttaccaaacagagagtagagtcacactttgatcttgaactgagagcatctgtcatgcacgatatcgttgatatgatgccagaaggaattaaacaaaacaaggcgagaacaattctacaacatttgtcagaagcgtggagatgctggaaagctaacatcccctggaaagttccagggttgccaatacccattgaaaacatgattcttagatacgtcaagatgaaagccgattggtggacaaatacagcccattataatcgagagcgtatacgcaggggagcaacggttgacaaaactgtttgcaaaaagaatcttggtcgactgaccaggctgtatctcaaagctgaacaggaacgacagcacaattacttgaaagacggaccctatatttctcctgaagaagctgtggctatttatacaacaacagttcactggctagagtcgagaagatttgcaccaatcccgttccctccactatcatacaagcatgacacaaaattattaatcctggctcttgaaaggttgaaggaggcctatagtgttaagtctcgactcaatcagagccagagagaggagttaggactcatagagcaggcttacgataatcctcacgaggctctctctagaatcaagcgtcatttgctaacacaaagggctttcaaagaagttggtatagaatttatggatctttacagtcatctcatacctgtatatgatgtggaacctttggaaaaaatcactgatgcttatttggatcagtacctctggtatgaagcagacaagagaagactgtttcctccatggatcaaacctgcagattctgagccgcctccgctattagtgtataagtggtgccagggcataaacaacctccaagatgtttgggatgtcaatgaaggagagtgtaatgtcctattagaatccaaatttgagaaactttacgaaaagatagatttgactttgttgaacaggctgctgcgtctgattgttgaccacaacattgccgattacatgacagccaagaacaatgtttttatcaactataaagacatgaaccacaccaacagttatggtatcattcgtgggttgcaattcgcatcatttgttactcaatattatggacttgttttggatttgttggtacttggcttgcagagagccagtgagatggcaggaccaccacaaatgccaaacgattttttgacattccaagatgtgcaatcagagacttgtcatccgatcagactgtattgtagatatgtggatagaattcacatgtttttcagattttcagcagaagaggccaaggatttgatacaaagatatttgactgaacatccagacccaaataacgagaacattgttggctacaataataaaaaatgttggccaagagatgccaggatgcgattgatgaagcatgatgtaaatctcggaagagcagtattctgggacattaagaaccggttaccaaggtcagtgaccaccattcagtgggaaagcagttttgtcagcgtctattccaaggataaccctaacttacttttcaatatgtctggctttgaatgtcgtatcttaccaaagtgtcgtacacaacatgatgaattcactcacagagatggtgtgtggaatttgcaacatgaaggcagcaaagaaagaactgctcaatgctttttgagagtggatgatgaatctttgagtcgttttcataatagggttcgccaaatcttgatggcatctggatccacaacatttactaagattgtcaacaagtggaacacagccttgattggtttgatgacttacttccgggaagctgttgtcaacacccaagaacttctcgatctccttgtcaaatgtgagaacaaaatccaaactcgtatcaagattggtctaaactccaagatgcctagcagatttcctcccgtagtcttctataccccaaaagaactgggagggcttggtatgttgtcaatgggtcatgttctcatcccccaatctgacctcagatggtcaaaacagactgatgtgggcatcactcatttccgatctggtataagccacgacgaggaccagcttattccgaatttgtaccgttacatccagccctgggaatctgagtttattgactctcagagagtttgggctgaatatgctctgaaacgacaggaggctaatgcgcaaaataataggctcactcttgaggatttggaagattcctgggatagaggaataccaagaataaacactctgttccagagggacaggcacaccttggcttatgataagggttggagaattaggacagagttcaaacagtatcaagtactgaaacaaaatcctttctggtggactcatcaaagacacgatggtaaattatggaatctaaacaattacagaactgatatgattcaagcccttgggggtgtagagggcatattggaacatacgttgttcaaaggaacatattttcctacatgggaaggtcttttctgggaaaaggcatcagggttcgaagagtcaatgaaatacaaaaaattaacaaatgctcaaagatctggtttgaatcaaatccccaaccgtcgattcaccttgtggtggtctcctaccataaacagagcaaatgtatatgttggtttccaggtgcagcttgacttgacgggtattttcatgcatggtaaaattcccacattgaaaatatcattgattcaaatcttcagggctcacttgtggcaaaaagttcacgaatcaatagtaatggatttgtgtcaggtattcgatcaagagttagatgctttggagatagaaactgtacaaaaggaaaccattcatcccaggaaatcttacaaaatgaactcgtcctgtgctgatgttctcttgttctctgcttataaatggaatgtttccaggccatcgttgttggcagatacaaaagacacaatggataataccactactcagaaatattggatagatgtgcaacttagatggggtgattatgattctcatgatgttgaacgatacgcaagggcaaagtttttggattacactacagataatatgtctatatatccttcaccaactggagtactcattgctattgatttagcatacaatcttcatagcgcctatggtaactggttccctggatgcaaaccattaattcaacaagccatggccaagatcatgaaagccaatcctgcgttatatgttttaagagaacgtatccgaaaagctttacagctgtactctagtgagccaacggaaccatatctgtccagtcaaaactatggagaactgttctccaatcaaattatttggtttgtggacgacaccaacgtatacagggtcacaattcataaaacatttgaagggaatttaacaacgaaacccattaacggagccatatttattttcaatcctaggacaggacagctgtttttgaaaatcatccatacttctgtttgggcggggcagaaacgtttgggacagttagccaagtggaagactgcagaagaagttgctgctcttattcgttctttgcctgttgaagaacaacccaaacaaattatagtaactagaaagggtatgttggatcccttagaagtgcatctgctagatttccctaacattgttatcaaaggatcagaacttcagctgcctttccaggcttgcctgaaaatcgagaagtttggtgatctcattctaaaagctacagagccacagatggttctgttcaacttgtatgatgattggttgaagtcgatttcatcatatacggccttctccagattgattctcatcctgagagcattgcatgtcaatacagaaagaaccaaagttatattgaaaccagataagaccaccataacagagccacatcatatttggcctacattatcagacgatgaatggatcaaagtggaggtgcaactcaaagatctcatactcgctgattatggaaagaaaaataacgtcaacgtcgcttctctcacccagtcagaaattagggatattatcctaggaatggaaataagtgcaccgtctgctcaaagacagcagatagcagaaattgagaagcaaacgaaagaacaatctcaacttaccgctaccactactcgaacagttaacaaacatggtgacgaaattattacaagcacaactagtaactatgaaacagcgacattcagttccaagacagaatggagagtaagagccatatctgccacaaatctgcatcttagaacgaatcacatctacgtgagctccgatgatataaaagagacaggatatacatacatcttgcccaagaacgtcctcaaaaagtttgtcactatatcagatttgagagcacaaatttgtgccttcttgtatggggtgagccctcctgacaatccacaagtgaaggaactccgttgtctggttcttcctccacagtggggtacccaccagacagttcacgttccaaatatgccgccgaaacaccagtttcttgaagacatggaacctcttggatggatacatacccagccgaacgaactcccccaactgtctccccaagatatcacaacacacgcgaagttgatgtcggacaatcctgcctgggatggagagaaaacggttattatcacttgttcgttcactccaggatcttgttctcttacagcttacaagttaacgccttctgggtatgagtggggtcggcagaataccgacaaaggaaataatcccaaggggtacctacctagccattatgaaaaagtgcagatgttgctgtcggataggttccttgggttcttcatggctccatcacagggatcttggaattacaactttatgggtgttcggcacgatcctagtatgaactatgacctgaaactagcgaatcccaaagagttttatcacgaggttcaccgaccggctcatttcctcaatttttcttcattggaggatggcgacggtgctggagcagatggggaggatgcgtttgcttatattcaataaaaaactataattttaatgaaaatattgtgtagttcagttgtccttgatttagttttttttgtatataatattataagataaacttttt

SEQ ID NO: 95 - DNA, 3617 bp, Leptinotarsa decemlineata
  Annotation=Protein FAM116A; Tribolium gene name from OrthoDB database=TC016056; Blast E-value Tribolium Gene vs. Leptinotarsa Unigene=0
aggcacgtgcaataaaaaatggcagagagttttcaactatgacagatgaggatgataaaattatttgggaaggattccacaattggatttactgtatttgcgtgataacattcgacttagaacttgggcaagccctagagagtgtttttcccagatgtgtttcattgactaaacaagaaatctcaaacatatgctacttggcatttcccgattccaattcaggatgtatgggagatacaaatttcattataagactgcaaactggccaaggaaagcaaaatctccgtcctgaacatcacaactacaatgccaaatgtgccacctcccttcaaatcgatggtgctttctattggggatacgtatacttcaggcaggtcaaagacatcactttacctaggggttattttcagaagagtgttgtcatactgtccttttttccatttaataacttatttagtaaaatatgtagtttcatcgctcccgaatattttgagaatggtgaagtttgtcttgaggcagtgtgccacagcattgaaagatggccacccccaaaaccaggcattgcactcaatctgccattactaggatcagttttccagacttatattccaccatctagtaactgttcagtgaacgccacattagcattgcttagcgaaaacagcgacaaccaaatacaaacacacgtagaagatttaaatttatttgaaatacttcagcctgttttgtcacatattcacttactatgggaactggttattatttccgaacccattgtagttatggcctcttctcctacttattgttcatcaatggttctggcactaaccagattgatatttccgttgcagtattgtggtgattaccgaccatatttcactattcacgatagtgagttcaagcagttcactacaaaagatcaaggaccacccccagtaattttgggggtaacaaaccctttttttgggaaaacactccgtcactggccacatacacttcgtttaagtgacgattcaggtcagtctcaaaaacaaaaactgaaaatgtcttctccagctaaaatgatcgataacagccctggaatttacacatcacacaagccttttgtacaaaaaagcaaacacatcatcaaaaagctgatggtcggagtgagctcaaaacggccgtttgaagtgcagtcagctctaatccgaagacatctatcggagctgacacatagtttcatgtttcctctagagagatatatagctagtttgatgccattccaaagaagcatatcaccctttaaggctgctccaaaacctcagccgttcaatccagatcatttttgtgcaactttagagacagcagggcctcaattgactttgaataatacaggaattaaaggagattgggaaggtttatacagaaagtttttcaaaagccctaatttcaaagcttggtttaataatagatatacagaactaacaatgaaactggaagcccttcaactcgaagccttagctaaagctaacttgaaagactgggcccagggtcgtcgcgaagtggaaataatagatatggttttgacaatcaagaataaaataagcaagtgtaatgaacacgatatccctgtaagccaaccgacgaaggatcaactcaatcaacgtttgaccgatattgttacttccttacccgatgatctaaaaaatatcctacatgtttcatgatacttactgatagtatataaaaaattgtatataagtgactcccactcagacaaccttgtgtttgacaatctctctttcaaaaatatgtcaaattatttccaagaacactaagattttcaaattaggctgctacttttggtgccttcaattcatactcacattgtataacaacttttctttttcacttaaaattttcgttagtgaattttaggaatgttcaacttacagaaattcattgtagatataccctgttgtaatctttttaatgtctgttttttttttgcaaaagctgaaagccaaatttgaaaaactttttggagctgagaatgaacgtatttgaataaaaattttgtttttgttgtaaatgttaaaatgagaatatcagatttatgaaactttatcaagtgtaaaattgttaattgcaatcttgtttacttacatgcagaatgaaaggcattaatttatgaagataatttttgaacaaggtaaaataagtcttatgttaggaaactaatagtattcaggttttctcctcaatacaaacggttgtttattcaacatgaaatgctcagttgcagtcaataatacaaacaagtgttgtagtcttgactttaatacctcacgaactcaaatttgaaggagagaaatatgttgtatatttaaatatttgtatcatttggtttatttattgaaaaatttcagtacccactgattgttaggtgaagttttgctcattatcaggatttgaaaatctaaattcatcaaatccttagtaccatttgctagtaccaatattttatacttgttgatttgagtgttttttaaagtttacataaaaaataccagtgtagaaattaagagatatttccaatttgttatattgtagcaagatattaaaaagtacaaaattgtcctgcaaatgaatgcatgtcccagtggaacaaatatcttgctcaatacaatagtctataatactcacataaaccttatctgaacattgtatccgaactaatgaaatgcaccaagaaacattgtcaaccaccttcaaacaatgaaccccttatttgaactacaactatttcacccaatgaataccatgaaattacttcactttaaatgccacatttaagaattacgagtttcatgcagttgaaattcatatgaacactcgttcattacattgtgcagtttttacattccttttggtgtacaaatttagaaagttgtatcagatgttgtttctttcagattgtatcagatatatttgggaatctttcagtttcactgaatgctggtaaaattttctcctttttgttggaagatttccactctctcaaattatagaaaaagctttttccaaacactgatcttctcgcattggcatacttaagtgacgaactatttggcttaatctacaacttcaactggaaacttcggctattacaaattgatattttaagtaacaaacctcacaaatatctacacgcaggcaatgcattttatcaggaatcttattgacaactaaaatcatgtttttttttaaatggcagtacatcaatattaatgtagttgccaaaaatcagttatattattctttgtgaaatagtaaattgttcaattaaataggtcagatgagagttttgataatttaatactgcctttaaattgatacatgtctcaatggatgtttccattatatcctttgaattttttgtgatattttccaaatgtttttcttgtacacccattgtttgaaaacgttttcatacacgacatgggattacaatggttcaaatctggttatgtgaaaaattgtttaagccatttgaacaaattttatacatatgatcaaaagttcatccgtatttatcattatacataggaatgtcattaaacaatttatttttc

SEQ ID NO: 96 - DNA, 3103 bp, Leptinotarsa decemlineata
  Annotation=Zinc finger protein 208; Tribolium gene name from OrthoDB database=TC006630; Blast E-value Tribolium Gene vs. Leptinotarsa Unigene=3E-28
atcaaaaacagaatgataaaacttttttttttacaaacgtattaacagattttcacatgaaggtttataaaactgcaacaatacatcagattcttcagaatgattgtttttatttgggtttgtcaatatcagatatcagtcaattcaatagcagttttagatattttgtaaattcaatctgttgaattttcatcctttttcttgtttactgccaaaatacctggattaagctcgaaaggcttttcatctaccgtaatatctccacctccaacatcttcgctagtaaactcgatttttatactttcttcatgaatactcaagtcattcttgacatctttttcttcaggaatattaaaatcatcttcatccaacctttcgactgaattgaatgtttctgtatgaatcttttcatgatttttcaattggctcctatatgcaaacgatttcaaacataatttacaaacgaacgacttttctccagaatgagtcctttcatgagttctcagatgtgcctgctgtctgaatgaggcagagcaaattttacataagaaaggtttttcacctgtatgaactctctcatgaactgctaaatcccctctcttgaggaaagatttagaacagaatttgcagtgatgagattttttccctgtatgaatcttttcatgctttgtcaataaatctcttcttttaaaagacttcgaacatattctacaaatgaactgtttcttctccttatcagtattttggtgttgcccacaactattttcacaatcaaacaagttcttgcagcatactttcaaatgattggcgtcagaaacgttattgggctcgtctttttcctcttttatcattgcattttctgcttctgtaccctcttgaatttctgtgcctggaataagtttgagagaaggttttatatctggggtaatatcctcatctagtagatttttggtcgtaatctcaaattttatattttcttccttaatattcaagttattcttgatgcctgcttctggaatatcagattcatcttcattgtaattttcgatttttactgttttacaatgatttgttgacaaattcttggaaaattgtctttcttgtttatgaaaattcctttcgtgagtcttcaaagacctctcagttttgtaatattttgaacaaatctcacaatgaaatctttcttcagaatgagtcttttcatgaattctcagattattcttagtactgaaagatttcgtgcatatcttacactgatataaatttttcctttttctaaatgagatttcacatgtactttgaatgttctcagcatatagaaaagtttggggcaaaatttacaagaaaatggtttttctgtatgaatcctttcatgatcattcaaataactcctagcagtaaatgattttgaacagaatttacaaacaaacggttttgcacctgaatgaataattagatggtttttgaggtgcgttgaagttttgaaagaacgagagcagattttacaaccaaaaggtttttcgcctgtgtgaatcctgttgtgaattaccaaatcactctttctacggaatgttttgttacagattccgcaggaaaaaggtttaattcctgtatgaatcttttcatgccttcgcaataacattttacttttacaagatattgaacatattttacaatgaaactgttttcctttcttttcaactttctcatgttgtattaactcattttttccaacaaaatttttattgcattctcctgtcaaataactagtgtcattggaaatattgctgggtgtaatcttcatgtctaattccttggatgtttttgcatcatctatttctgtaacctgctgcaattctatacctggaatgagctcaagagaaggtttttcatctagtgtgatgtctctctcgtcaacatctttgctagtaggttcgacttttatattcacttcatgaatatctttttctaaaattttcaagtcaccctccatattttcttcataaatattaggattatcttcatcgaatctattaactaactggggtatttctgaatgaattttctcatgatctttcaactgatccccattagcaaataatttcaaacagaatttacaaactaccgggttttctcccgaatgagtcctttcatgacatttcagatgtgctaattgtctgaaagaggtacagcaaattttacacaggaaaggtttttcacctgtatgaagtctctcatgaacaaccaagtttcctctcttaaggaatgatttagaacataatttgcagtgaaaagattttttacctatatgaatcttttcatgctttgtcaataactctcttcttttacaagatttcgaacatattttacaaataaactgtgtcttcctctctgtatgaatcttctcatgttttgtcaataaatcttttcttttacaagatttcgaacatattctacaaataaactgcctcttctccccttcagatttatgatattgcacacattctttcaaatggttgacagcggaaacgtttgtaggtgtaatttctatgtcttttttctcaaatatcattgcattttctacttctgtacccttctgaaattcaattctttttactttttttgcttcacatagtattgtagacaaatcctcagaaaatttccaatgatccacatctgatattaaattgacatcaaccaattctggttcatcatattcctgttttcctataaatggaaaatttggactgttgaagtcattattcgccattttcaaaattattcaatttccattagtcttcaatttaccaaacaaacccgatatattgaaacttagccagatagttgaaaaagtcctgtaagctgttttcatatattgtggtttcttatgcttccctgagtgaaagtaatttatttcacctatttatcagtgtctcgtgtttataataaatgcaataaaaaacattaccacatcacgaattcacaattaaataactcaaaacaaacaatgaacttaatacgatggtttgtggtgtagtatatatttcactgtagccacaaaccatatggtctgtaactgtagctgttttagaacccccgaaaa

SEQ ID NO: 97 - DNA, 3356 bp, Leptinotarsa decemlineata
  Annotation=Sorting nexin-25; Tribolium gene name from OrthoDB database=TC007060; Blast E-value Tribolium Gene vs. Leptinotarsa Unigene=0
gtaagttaatatataatttttcaacactgtttcctattaaaaacattagttaaaaacatacttcaataaaataatgaagtgtggtgaatggtcatgaaaataatggtaacagcaagtatcaatcacattttgactagaaatagaagataaataaatctattctagatatataaataaatgcgtttaagcctcgttatgcctaaattatattaaaataataattgttcatataacaaaaattgtactattaacctctaaaaataaaacacctcagaaggtgaaaacaaaaaaatagcgatgtgatctcaactcagttccgtaaacactgcatccaaagtaacttccagtaattcgtaaaataaatgtttgttcatgtttttctcctgaaatgcatcaaacactttcttagcgccgtttcttgcagcgttatttcccaccagcgtcgtaagtaactctggtacattatttacaaacatttcttgggctttctgggcagttcgtaatctctcttctttcgacctattcgcagctggaacagctagcgttccgcccggccaaaaatttttcaaaatcaacgttatatagtagtgcaacattccttctgaaaaccaccaagagatcgtctcataaatctgcctgtttatgttgcggccgtaggtcacctgaacgaagccaatgagtgtttttcgtacatatttgaaaactcctctcatgtcaaaaatttcgctgagcagactatacagaggttcggcgatagcatcatctgacatttttggagaatgtccgtttgtcctgacgaaatcaacggtatcgacatttgattcaagactctgtgacatatcttcctcttcactctctttgagaattgagtaagagtccctactttgttcgctaccgctcttgaacaatgtcgagaagaaaaatctagactttttggggctcggtgtggaatgtttcaaatgttctgaactggggctcagaaaagagtatatagcttcactttgattaagcctgtcatcctttaagacaaaattcaaatacttctgaatttgctgtttagccctgtccaaagtaagtttgtcagtcttcccgaagaggaacttgaaggtatttgaaggaagttccaagctgcgtatatcagaacacagagggcgcaattttttgtgtagctcttgaaactgtgttaagctcctacaaacaacccaacctgtacaaatagtttcctccccatcgggagattcatcttcagacatctgcacgaccaatacaaactgcagtggttctctttcattgggtatctctgcactttgtactatagccctccatcgccctaaattctctgcccaaatctctgttcttgtcaagtgggcctccagttgtcttttctcgccttgcagccattcaactgcattctccagtttactaagaaccttcgaatcaggtctcattgacaaacgtaaggcttccaaagcctgagacttattgttcaatttttcctctagttgatctaattttctcctggcataattcgaatggtcaccaacattcaagttattctctggactactcaaagagtctgttgaaatctgtttgtcatctactgacctactgccttcttcagtcaactcatcttctctttcgatggcgttaaccatttctttgtaatagtcactgattaaaaaaggctgataatatttttcttctaaagtttgaacaacttgcctctgcacttcataaaaaacttctggtcccttatcacctaataaaaatgattccatgcgttttttggtggtcttgtcgacttttatctcagaagtggaatttctaatgaaagtataaaaaatttctgcaccaagttgatgccagttttttctttgagctgtacgcagttcctccactgacgtccagaatctaatcaagtcttggcttgccaaagtttgcagaaactgggataaatatttcctacccagaacatgctctaaaatagtctgtaaagacagtacccttttcatctcatctccatactgacatcctgaatcccaaccgagactcatcaactttttctcgcactgttgtttagctgaagtcagttggtttatgtgctttctcagctttttagcggcgctgatatcagacttttgtacaccagcagaagataaggtagttttgtcattgtctagatcgactccttttgcacgattcaagttttgaagggttgtagcttgcattaattttgtcacaatattgtacctgattgatctcagcacttgaatatcatcaattttatcaattaaatcttcaaaattgttagcactctcaagagccttctttggtaggtctacatgcacgtgatttgcttcaatatagattatgacattgcgattaaagaagtctggatcagtgatgttgtcaatcactggtttaagaactttgcaacataggacttccctcacgaaatattttgttggagataacgaataggtccttggcagtagaaacataatcagtagctcacttagtgtacgtagatactcaagttctttctcagatgacataacatgaggagaaagttgaaagatcggcggccgatccgattcggcaactactgctttcgccaatctgatcctctcaaaatgatttgtaattttcagaacaatgtctcctgctattagcttagctcggtctattctggataatttctcatggagtgtattcaaggccccccataagtcatccttgatattggttcccaaagtatccaattcataagcgaagtctgttagatagatcaagatataatccctaatcaaaaagtctagtagctgcattagtaaactgtcaactgttcgtccaaaaatatgaggtatgtgtgatgaaactgctttcaaagtgggtgaagtctcataatccttcataattttgtttctgaaatgttcagactgcttgagggtatgttcagcccccactgtagttttgtgtggcaaagaaagcataatatttgtccatagagcagtagtaattcctaataatatgctgaatataaacaaactgagaaagtgaaaataatataggcatgatggagaaactgcaactattccacacaaaacagatattattgatgttaaatatattatatgattcatcctgaaatacagttattacttcatatatttcatattaaattttgaatatttatgtacattggaaaatactaaccctatcatttggcaaacattgttatcaaccttgataacgcatattttaaatcctagaatatgataatcgagaagtgatatcaataatatttgaaccacttttcatccagtgactcgtaataaaattctaatatcaaacat

SEQ ID NO: 98 - DNA, 3114 bp, Leptinotarsa decemlineata
  Annotation=Putative GTP-binding protein Parf; Tribolium gene name from OrthoDB database=TC001511; Blast E-value Tribolium Gene vs. Leptinotarsa Unigene=0
acaatgacagtacccaatacttattttcgaatatgttgaatgttgatactacattattagcttcaatggaaaaccttcaaaagagctcaggtttatttcatgaatataagattatgtttaaaataataatctgaatcagattaacattagatttgaagctaatcatgggagattcacataatcgatttcggaaataaataagctatttgtgacttgaaggggttatatttttaggagtgattaatttttgagaaagaaagtttttggctctccaccactccacatcaatacaaaaaattgcgggaatcttccaaagttgcttctttgcatgatctacacatccatgtatagagttacttattttcaaattgattacttcctttctttggaagattcccacatttttttgtatcaagatggagtagtagaaagccaaaaactttctttcccaaaaatacatcagaaatattgtctatatttttgcttcaaaattccaaagatttcaatttcaataagaaaagttccagaactagagcgtaattcctctttatttttacagcacactttttttttcatcataaacagctcatgaatcatttagtacaaaaccatagcaaaggaaaattttattatcatttcaaaatatcactttttagtaaaaaatatttggaaaaattgcttcagacatcaatggtcctaacactatcttcacgattcaaaaaaaccacaggaaaacatcaacaatcataatctgtataatcaccaacagacaaataaaactattttctccaatctcttttcatttccatctttcctcgaattaagtaactgggttatgtagaaatttagtaagctttggaagatgcaagcgtcacattaaaaattcaattcatactcgttttcaatgacgccaggtaaaatgctaaatggcctcgtaaccggtttctatgggggaaccagctggaccgttcaaaaactcttccaattcgtctctgtgggaagtggtttcatcacgagattgacgtttgtgtttcctgtctgctttggttgtatccttatgtttttccctatctttatctttagacttcttcttagctttcttttcagtcttatcttttttcttcttttcttttttcagagagctagaagtatggagatcttcactgtcactatgaacactggcattgtttgaaccattagcttgtttggtggaaagaagttccatgtgaacgttggaggagttcatgctgttactgtcgtcaaaagcggtactgttgctgtagtccaatgtttgactcacaacagaattatcttcacctccttctggagatctcctccacttggtgtcagcagccatccatccatcataagcgtctgatgttaactctgagatttcagaattgatggtacagtcgaattcatcatttgtttgtttcatatcaaagtcttcgtgcaccattctttcaacttctatttcactactctcagactgaaccattcttgtaggcgccacgaacggaggttcctgctttttattgtattttggaagtttcgagaaagacatttcttcaggttcgaaatcttcctggagttcagaaaccagagggtttcctgtatctgtatccgactcggagtgttcttcttccttggtattattctgggcgctcaactgaacatcgtctaagaacccagtaagctgtccaccgtctggacaaaattcttcaacagacactatagggctgatgtcgagtttttttatgtcaggaagtccttcagccaccccagtattaacaattttagaaacgaatccggaactcatactggagcttttggacatttgttgtggtgccgtatttgttttggatacaagtacagaattgccataaggtataggttttccagctccaataactatagaagcgctctgcgatcttttcatttcattggggcccatgcctgagggtgcttttactaggggaggaggtatattagcattcgagtccgctacctctctccgttttttgatgagggtgtctaaaaatttgctgtagttcgcctcgtctgagacacagaacatatccaactcttgaatggtggcattggtttcaacttcattgcgttccaactgcctcagtaacgtttctctttgtagttgaaggaaaggaagattgaagaatttatgaagaagcttcagtccaaatccattcctcattgaggattcggaatgacgtacttgagctgaacgtgtgccagctatagattctatataatagctaatatgatctggagtaacagtcctatggtgagacatatcacagtgatttgacaatataataacaggaatgtgacccgggattttaggaagttccctttgaacataatcaaatgtccaagtttttgtcagatcaatcatcattataaccccgttcgtgcccttgtatacatccaagaactcagcgtcaagtgcatgctcttcagcaacttctaactgggaattttcaagtttcaatccttcaaaatgcttctttttccttcctcggtctaccacatcccacacttccactttgacaatatcgtctgtggccttgtagctccattgaatagaagttacttgtatttcttcggtaggaatatactcttcaacaaactttttgccttgcagtctttggaacaaacaagtctttcccacatttctatctcctttgatgactattttcatgttatactgtacacctctcgcaaattttttttgtagagatgatgacattgcctggtgtcctggaggtctagcactgataacagagttatttggggacccatctcccttactggtaaatcttttgatcgcagaaaacatgttctcattatatcttccaaagtcccatatgctagaggttatttcagaagaaaacaattgttcttataatttcaatgaatgagttttttgtgtcacaataatctgatttactccattactttttaggagcatgagaactcttccaaataaatataacacttcttaaaacatcccaataatatttgacaattgtgacatatttacagccgagagtaggtattctcggtttacagtttgtattttttgattccttcttc

SEQ ID NO: 99 - DNA, 2266 bp, Leptinotarsa decemlineata
  Annotation=Eukaryotic translation initiation factor 5; Tribolium gene name from OrthoDB database=TC007510; Blast E- value Tribolium Gene vs. Leptinotarsa Unigene=0
ggatttggtagatttttttcacgcattgaagttgcaagtatgcaagtggatgtaaaattttagaaatcccacttagacatttgatgttgagattatatgaatgttacaagaacaaggttgctgcagtttttgatagagccaacactctcctaaaatttttccctcatcatatatcaccaggaagtgaacatatttcagtatctctggaagttttcgtccaggagggcgctagttatttatatgactttagtaagacacaaagaaattggttttacgttggattcgacctggccaaaacacaaagagacattcttaacaagaagcttaattgggaatttagggccggaaccagcgaggtgcatgaatttgcagcgacgccagcccacctgttataggactacaaaattttcttctaatagacatcggaaactccaaccattcagagaaacgtgactggctactgaaacatcattccaattaaagaacatacaaccattaagatcaacactggatgccattcaactcaaaacaactctaattattttattcgtaaagttcatcggcagcaatcatcatgagtgttaacgtaaatagaaacgttagtgatgtcttctaccgctacaagatgccacggatcatggccaaggtggaaggtaagggaaacggtatcaagactgtcatcgtcaacatggtagaggtcgctaagtcccttggcaggccacctacctaccctaccaaatactttggctgcgagctaggggctcagacccaattcgatttcaaaaacgagcggttcatcgttaatggttcacacgatgcttccaagctgcaggatcttctcgacgggttcattcgcaagtttgtgctttgtccagaatgtgataatccagaaactgatttgatagtatctctgaagagaaacacaatttctcaaggttgtaaagcttgtggataccacggtgtgctggaatccaaccacaagttgatgactttcattctgaaaaatccgcctaatttcaatcctgcgagtcagggatcttctttgactgagggaaaaagatctaagcggagcaagcgtaatggagaatcgaatggagaccaagaggaacaagattctgctcttgattcgtcagtttctgaaaagcctgatgttggaagtgatgatgatcaaacagaatgggcagtagatgtgtctgaagaagcggtaagagcgagaatgctggatttgactgatggagctaaaaatatgactatcagcgatgatcttgagaaatccgagaaagaacgtatggacattctctacaacatggtcaagtcgaagagagacagcggaattttggataacaccaacacccagaaggaaattttgaacgaagcagagcgtctcgagattaagcaaaaggccccgctcattttggccgagttattgttcgatcacaacatccttgtgcaagcaaagaaatatcgtttgctgttccttcgtttcactttgaatgagaaaaaagctcagcgatatctgatgggcggtctggagcaagttattgctttacatcgcgataaacttatgagcaaggtccctgttgttctcaaggtgttctacgatatggatatacttggagaggaatgcatcatcgagtggtctgataaagtatccaaaaaatatgttgcgaaagaggtcagtcaagaaattcatgacaaggcgtctcctttcgtgaaatggttgaaagaagctgaatccgaagaatcggacgacgcagaaaatagcgatgaagacgacgacgacgttgagatagtgtacaacgatcgcgcccaagtacatttgaaagcaactcctcagccaaagccgaaggagacagaaatagaagatgatggaccggatgatgttgacatcgatgccatttagtttatttgatgatgttagttatattacgagagtgttctatctatccagtctttgattcacttggtaaagttctaacactcattcttcaattacttgttattattgttttcaattttccaatgtaattttatttactctccacaaattatgcaatatgcggtgaaatataaacattttcctactttataatgtttttatattgttagtattgaaaattttatagaagatactatgtatacttttatggctgtcaagagcatattcacggatatccaagtctatcctttcaatgtcagtaaaaatatgaactaaagaaaaaaaaaaaaaaaaaaaaaaagtaaactctgacgttgataccaactg

SEQ ID NO: 100 - DNA, 4276 bp, Leptinotarsa decemlineata
  Annotation=Diacylglycerol kinase theta; Tribolium gene name from OrthoDB database=TC000782; Blast E-value Tribolium Gene vs. Leptinotarsa Unigene=0
actttccccatggactttgctccagtcagcatccatgaggaattgagcccttagtacaggggcagattagcgacagcgttaggcgtcacttcctggatagtaagaccaaacgctacccacgaaacaaaccactccaagagcattcgttaccgtcgaggaagcttcgaaaggctcgtcggttaggagggtcgtagaggtttagagaaagtgaccttcccgaccgatgaactgtggagaaattcctcgacagtaacctgaaggcttggagtagcgaaacaacacacctgccactcgtgtggcttccttctattgggatgggtgactaagattgcatagcctactttcgatcatcacattctgggttacatctctcggttccatccgaaagctatctctattacaaaacacacatctacactaagtagttccaacttgtatttcgtcactcttgcactctgtcctcgcttccatggatttttcaaactgaaagctgctgccagaaacgtcggtgatcggagtcatcttttggttggagtcggtggtagtccaactagattcgaggatggtgttatattttcggataagcgcgagcgttgctcacgcaaggtatctgcgcaggcgcagagtacgctttgtttttattcgtaaatgaacttttaaaaccataacacgtttacaatatcgagtacattacttgtactcaaaacaaactatttaaaattaaataaactcgaacaggcattcagccccacacttgtttgttttcaccagtaatttggtaacaataccatactataacgtaataatattacatgttttaactatttcgaatacatattttttatgtaaatactaaaattaactgaaaaaaaaatcgcccttgtcccttgggcgtacagtccgaaacgaaagaaacgaatgtcgaagcaacacttaaaaggtggtgttgttggagtctgtgggggactctccatcgtgagaaggcaaggggaccagttgtacccccggtgacaccagcattgtcggttcggtgttacgcctcttcattttacctttcatcttcttcaacatggtggcctgaggaggggcgcattaaaatacgaaaatttctcatacaaaccatcgttataccaaaaatctactggaaccaaaccataaagcagtaacgttacaattatatgacggtcaagcaaaataaatcatgccgatgacgatacagaaatgatgataacctcgggaagatacagaagtttgtgaaaataggtgtgtagattggaaacgagttttgaatttagtcgtctgtactcttgccccccctccccgttggccggtagtatatttggttctgtaggccgacgcttgaacttatttttcttcagcattgtcgccttcagagcggattttaatactacaacatcacaaggactttgtacccacggttcaccatccacttgaacaggaatgtcagaattgagatgaattttgatgtgtccaccctgtgcgatcctcatagctgttctcaagccagattgaatttgtcctaaatggaccacaccagtgacacctacaacctctaacatcccatcccagtggtttggctttgaaaattggtcatccttctctggaccccaaggatttgccccagaaccccaacttaaaatattcaaaataattatcccttccacttgcggtaactccaccaacttgccgtccacttcgagcctcacttctttgtgcaggtccttgcacatttttggccccaccattttccgcagacccatcttgacgtaaacgctcttgttatgcaaccggctgatgaacttgctagggttttcctctcgtgcgttatggaaatccagacagaggtccgcatcgataccaatcccgaaatagttgttcatcacgaaaatttgggaattgtcctcgctcgtcgaacctgccactactgcttttctaatttgctcattggtcactttcattttggacagtttttgcctcttcttaccggtggagttgacctgcttattaacgttgtcgtctggtttatcctccggatggaaaaccactgtccatcggtctaagcgtatctcttcggcgtctattacatccctgaggaggttcaaaggatcttcgcctcccgtataacccgggccccatctcaatactctcgccaagtcgttacctgttcctaatggtacaatggcacacgctggagaagagcactgcgaatcctgtccgacattgtcgaggcattgcaacacccacccgattgtaccatctccaccgcaaacaagtattttgtagttcttgatgttcctgaatacatataacccgggcaatggtccgccgttatccaaatcgaatacctggtaagggttcagtaattttctgaagctcgatattagttctaaaccttgacatcctccagactttacgttaacgaaaactaagagaggttgtacaccttcgggtatcattgagggttcgatgttgggcaataacataacaagcaaaggttgtttatcttcgtatttcgattcgcgtagcgtataaagtgccctcacagctttatcagagtcttcgtaagtgattaccatcgatccgtattcgtagtagatcggaccgattttggaaaatttattttctcttcctaaaaaatcagtgaggatattttcgtaatttcgttccgataggttgggtggtagatttccgacgaatagagctagatttggtccatgaggatcttgtttcaattgaaggtagaatcgcatcaactccatctgtcggatactgtccttaccaagctgtttcatgatctcccatggtctttcgttccacgacaaaactctttcggtgactcctctatctagaagtacttcactacaccgatagtcttcagcgttgtaactctccaatccgaaacgtttaagtgcttcacgtatgaggtcgcctacagatgtattggaatccacaggcacggtgcagagtgcctgagatacctggagttttccgggataaacacgtacttctcccgaatcattatctctgtctttgaatcgaagaaaaactgatgctcgttttccttcaattcggttcagactgagcacaggagtaggatcttgcaaaacggcttcatcctgcgaatagagatccgtgaggtggaatgaattcgggtctttcgtgatgtggaacgccctcaaagcttgggttaagacttgcttcaaggacgcttgcctcgacacgacgacgatccggaatatttttcttcgtagcgagttgttaccatcgtaaaccttgataacttcttcatctctttcttcctgatttttgttctgcttgtcttgccggctatccctgcccggtggatgtgactgggcatattcctccgactctctgtagcgaccagtgtcaccgctgctgaattcttccgagatactccgtggagacagcgtgtccttccgtctgacttgcactccgatgatggcttccatgggtacctcggttcttggtatgctgacggcatgcggtggcaagtagatgggttccagaatcccaaatgtgcactcgctgttgatgttcacgtgacatgtcgcgtgactcgtcattccacaccattcgcatcgatatccagacaaacattccgtggtccagcacgttttcttgcagagggcacatttggagttacttggaagatttccttcccgccaatggtgttggtggtggacgtagaccagctgcttccccggaagataagtagcgttctccttgcaatcagcgaccgcaaaatcctggcattccaagtgtacaaagtactcgcatatctcacagtggatcgactcactatcatccaatctcttcctgcagacgttgcaaaattttctcttgtgatgaagtgactcggaccaacaatgagctaccggattcttgataaggctggcggctacgctggaacacggggagaccacagtcttcaggcagcgatcatgcaccacgaagttgcaaacttcgcagatgaagccctgctggatgaggccccacagcatgtcgctgcagtggtggcagtaggtgggcttgtggaaggtcttcttgcagaagctgtggccgtgcgcggcgggcggctgttcctgcgggcccgccaccgacgccattatttctccgagccaccgttcacgccagattttcaccgtgaacacgcacttgcagccgctcgacgacgcatattacatgtctatgtgatctcgaaaccgtacgcgtacatgtcgctgctgcctttccg

SEQ ID NO: 101 - DNA, 1308 bp, Leptinotarsa decemlineata
  Annotation=Ras-related protein Rab-27A; Tribolium gene name from OrthoDB database=TC004860; Blast E-value Tribolium Gene vs. Leptinotarsa Unigene=2E-121
acaaaattagttttattcaacaccaaagtatccacagatacaaaagctataatatatatcatttataaagtcactctccataaaatctgtgataaaagtaattttaggctcaacacgaataagttctaattggttcctatttgataatttagagttgcaacaacaatagattaatactggttctttataatattcctcagtcttgtgggtgaccgaaaatgtcattttaaagtcttcaaatacaggtttttggaacacacttatttgagctagaaatgaatctgacaaaataattgaagattttctcagagatgtgaaaaaacacctattcattatttactttgtgagaggtcggaagatgaggatattgaaaaaatctcattaagagaggcagtgacttatttttcaaactcactctataactcatgtattcgctcatttaaaaatgaatcattccagctaacagaccttgaagaagactagcaaccaacacttgcaacagtcaccctggtggcaataataattattatcaacatgaacatttttggttaggcggagcattcaagtcaggatcattgggatctcttggtcttcctcttctaccaggaagcatggctttatccactgcagtctccatcctcaacatcactctctccaagagagtttccacagctctgttgatattttgtccagtggcagcacttgtttctaaatatggaagaccatgtttttcagctaattctcttgctctccattcggttattactcttttatcttccaaatctgctttgtttccacataatactacatcaggagaatcacaatatgcgtgcaacctcaactgctctatccagttacgaatttctaaaaatgattgctcgttggtaagatcaaagagaagtaaaaaccccatggcatctctatagaatgcagttgttaggctgcggaatctttcttgtccggcagtgtcccaaagttgtaagtggatcctatggtttctgcctttcgactgataaatcattctcttctctctgaaatctattcctacagtagatatgaatcgtgagttgaacattccatcagtatattgataaagaaagcttgtttttccaactcctgaatctcccagagccagaaattttatcaaatagtcataatccatttcctataatataaattcactaacctgttgactcagaaaaggtttttacaacctgttgagcagaaatcatatatcattaatgtacaattgacgaaccacctgtaaatccatatacgttaacagttgtaaacgaacggtcgatgttt

SEQ ID NO: 102 - DNA, 3905 bp, Leptinotarsa decemlineata
  Annotation=Ras-related protein Rab-7a; Tribolium gene name from OrthoDB database=TC006036; Blast E-value Tribolium Gene vs. Leptinotarsa Unigene=5E-92
aagattaataattttgtgtcccattgtgtttgaatataatgtgatgtcacttttacttgttattgaaatcttgtatatactagttaattacctattgagtcatatcctattactgttgtctttttaacagaataaaatgtcgagcagaaagaagacattattgaaggtgatcatattgggggattccagtgttggaaaaacatccttaatgaaccaatatgttaatagaaaattttcaaaccaatacaaagctacgattggagcagattttttaacaaaagaactaactgttgatgatcgaactgttacaatgcaaatttgggacactgctggccaggaacgtttccagtcattaggtgttgcattctacagaggggcagattgttgtgttttagtatttgacgtaacagcaccaaacacattcaaatctttagatagttggagagatgaatttttaatccaagcatcacccagagaaccagaaaatttccctttcgttcttcttggtaataaagttgaccttgaacctagggctatctcttctaagagggcgcagcaatggtgccaatctaaaaataatataccttactttgagacatctgcaaaagaaggtctaaacgttgagcaggccttcttagctatagcgaagaatgctcttgcccagcagaattcaactgttgatatttacaacgaatttccagatcaaataaaactcactaatacacagaaaactaacggcaatggtgatagttgtgcttgttaagttaaggtacatataattcttttaaattttgcattataatcagtgcagcccaatattgtgttataatactaagtgaatattcggtttaacaaggtttaatttattttcaaattttattactgaatacttgaaatatatcctattgccagttatgatcatgttcatcagtggtaggaaaatttaaggagccttgaagtttgaaagttttttttattgaatttatttgctgcaatatttttaaatgtatatataataaaataatgttatttatattatagttgccttaaatgtgatttcttctttttaatgacatttgtataaccagtggaagtaggaggttttaatcacattagttaaaaaaaccatatcagtccttttattatttcctgtagaagttacaacatatttcacataaactgatttatcactctttccctaatttttttcactaataaaatatatgatgattcattaggaaaatcaaccttgccttatgtttttggcagtttcaaatgaaaaggtgtatttgtagatcattgagaatttgtaaattacagatattaattacataataaatagtgtgtaagcatttggaatttgaattcattttcgtcctaaaaacattagaaagaatgaaaattgttaactctgatgttgttaatcagttttaggttggtgttctaaaaatattcatatttcaaggtatcaaccgacaacaggcacatttgaagaaaatgccttttcatatgcaaatcagatcaaaaagaattatggctggttacatcgtacaattcaagtttttttctcgtatgttcaagatgtttcatagaatttaaaaaaccatttcggtcttttagttcatttgacaaccaattaaattttttaaagagttcgctgtactctttattcactatataaattgagtcagagtgggtcggatgatttcttgaaggtaatattccatcatccctctaggcaagccaccagcctggcagtttctaaagtgagacagtctttgatgcaaagattcggtcaatctaatatcggctttgcagccatcgattggaattatatattagaaggcatgtgagtgagtttgccaatgttttatataacctgacaccggacaacccgaaggccatcgattacatcgacggttcatacgccgccatcaataaaagttgtaatttcatatactgagtattcaaggaccctatttctcagacgctcgcaacaatgacgttagaatattggagaatccgtttgaaagaaactttgatgacatgaggggatggtttaatgaaggtgtcttttttattgtggattggggttatcgaaatgccatacccttactgaataatcttggcactcaatatgaaattgcccgcgactgttccacggaggcaacaacagctttccagtgaggaatcaaataaatctcgattagtaacgaaaactagatggatagttgaaccaagaaatggacatttgaaaattatgtttgagttttttgataaaacgattgaaatgccacacgtccacaattttagcttagctggctcaagaattgctacgagaatcacatgaggtaaatgtcgtccagactcgagtggaagtggacaatcttcatctgagaaatggtcaatgggtccttatgaatggaaacctgtttccaaagtttcctcgcctcacaataggttatcaaagagatttgaccgtaggtagataccaggttgaactttcaccttcatatatttatacaggatacattacagagggaagatattctcgaggaggaacttggatccatgaaagtcaaggttttttcgatgttcagaaatgccacaaatatgatgaagaatctgatgaaccaaatgagcccatattaggatattattgtacttgtaaaacgtgtgctaggactttaggaacatgcgcgcaagttgtgcgattgttggggtcatgtcgagcgtgataccacaagtatattcatgaattctcattttagataattttgtcattgaaatgtttcgaagtttgtctaagaaacaatattattttccgttacaaaggaattattgattattcgagaaatcaatgaaatactatacttcaaaccgtggtattcgtgaggtagacactgtgaaacattttgattatgaataactcatctgcattatgtcagaaaataaaagaaattcacagaaacataccttccccataattttggaccatcaacgaaactttatttggattcagattaatgagcacagacgttgacgcatttgtatatatattagctacatagtttcagaaaatcagctaaatatattggtgtaaagggatacatttttccgaaattgaaaatatatttttgatcgccccgtatcttccaaaatttaaagttggatggttggttcaaatgcaaaatatgatagccctctcatgtactgttgtaggtaaccacaattgcatatggataaaatgaccaaaaacaaagtttaaccctctgtatatccgccagttttgattctagaaacttttgtcatttgaactttctgatgcacatattgtgaactattccattataaaaattcagatcgaaacgatgaaaattaaattacggattttttgaaaaaactgcaaaatatcaaaatttcaccccctgtagaatccaaacgccggcattcagagagttagcgcaatggtaacttttgttcaagatggcatggcatggcatgttcatatgaaaattccagcgattttcatcgaaaccggtttttcataagattagtgctgggtcatttgtaattttcgacaaggatctagatttattagttggaaaaaagtgttggtagaatttgctgcattttgagttgctattcatgactttctgtcaaacagatgatcaattcaaaagttatatagtgttaacaatttagtaaaaaaagggttgaaagaaggacaagtaatagcaaaactactaaaatgcagcaaaaaccactgaaatatattctttcattatgtggtttagtcatttacattgctcatgccaagacaatcttttgtgatatcagatgtaaaattttcatcagacttgttaaactatgtgttttcgatgtctttataacttcaacttcaa

SEQ ID NO: 103 - DNA, 2194 bp, Leptinotarsa decemlineata
  Annotation=Mapmodulin-like protein; Tribolium gene name from OrthoDB database=TC030635; Blast E-value Tribolium Gene vs. Leptinotarsa Unigene=2E-71
cttcgatgtcttcgtagtcttcgttttcttgatcgagttttgtaaagcctacttttgtcgtcgaggttacgtttcaggcttgatttgtgttttattgttgcttgtgttgggaaaagatccgttttggaatggaaaatcgtttagaattagaaaagcgtggcaaaaagcccgtagaaattattgagcttattttggataatactcgaagtacttcaatagttggtctaacagatgaatacgtcaatcttcaaatcctatcccttatcaatgttggccttacatccctcaaaggattccccaaactacccaatctgaggaagctagagctaagtgacaacaggatatccaatggcttgaatctcttagaaaccagtcctaaattgacctatctcaacctgagcggaaacaaaatcaaagacttggatactttagaacctttgaagagtttgaggtatctgaaaaacttggatctcttcaataatgaggctacttctaccgataattacagggagaaagtatttaagatgataccaagcttgaaatatttggatggttttgatgaacaagatgctgaagctgaagaagacagtgatattgacgaggaagtcaatggaaacgaagatgacagcgaagaagaagaagaaggatcttctgaatctggagaggacatggatgacgtagggttaggagcagtatactctgaaaacctcgatgaactgtcagatgaaggggattatgaggcagttgaagaagaagaggatgaagatggtattgaggaagaagaagatgaagacgctgctgaggaagaggctcagcgggctgaagtctcaaggggtaaaagagaaagcatgaaggcgacgatgaaaactaaaaatccagattgcgtacatcatcaacttgtagtgatatgaacatttttattatcgaccaatgaagtgtctccaattcggcgagaagagactttttcagtgagtcatcacccctggctgtggtttcatattaaaaaaagttcaatagtcggttggtatcgacactctaattctaaattaatgtccaaaaagtattccacatgcaattataaattgaaagggctattttccaaggaataggtcacaatggaaaaataagactgacggtttctagagtattatgggaaacattcaaggcaggttttattgtattttactttttttgactagattttggagtgtaatgaaatggttttagttgaaccatgtgcttgctagaaaacaattgagaaaaaaggctcaattaggaaattcagatattggaatcattctcatcaagtaatcacactttgaggtatcgtaaagtacatgggttggtgtcaattcccactagcaatactttctctcttttagtcatccaaaggcagagccttcaaggatgggggaattttgaactacttttttatataaaccgaaacgtgcaatcttatttaaaaaacacttttttgtagaggagtctaaactttcttgaactcttacagctttcaaaccttccccagtctaaaaaataaatatcagaacataatagaggaactgggcaactgtaatcaagggcaaattgaaaaatttcatatcatccgcttcttgagagaattccaatcagtaatttgaggtcattcacttttttcctatcaaataagatgagattgatttaaaaaattaattgttgtaatggttagctcttttctgaaaagggatgatgtttcatcttgattgatgtacaaaaatttataaaatgaataattacatattggactttttcatggccaacttttcaactcaattacacttgcacacattctctgttctggatttattttatttgaaattatggaaggttggaaacaaagaaggattcacgaaacatgcacaaactcttcgacacaaaattttgtttcatatttccatgttacattttccttggccatagctcaccaagaaatcaattctaagatgttgttttcgtagtgaagtaacagccagaagttgttaaaaaagtgaaagtcaatggtatagttatattttgtacatccattaatatctaatgtctagtaattttaagggtgttaacatacatatgaagtaagttactgttttttattgaattgtgttatatcctgaattttctcaaattaaatatcttcccaaaatagaaaaaaaaaaaa

SEQ ID NO: 104 - DNA, 2049 bp, Leptinotarsa decemlineata
  Annotation=B-cell CLL/lymphoma 7 protein family member B; Tribolium gene name from OrthoDB database=TC012275; Blast E- value Tribolium Gene vs. Leptinotarsa Unigene=1E-55
tctcagcaatcaaatccactttgattaatttctactaaataaattatttacaaaagtatcatcttgttaaaaatacagatgctatactaaaattccagaatagtaggcactaaattctcagaaatattgcaattaaaaaaaaaaatttgtcaggttgtgattctatatttcaccatgttctatttaaatcatagactcgcagctaaatggtcataaaataacggacctgttttattcattaaagacacttcctgctaacgaaatgtattcaacagcatcaatgtttattaaatgaatataaaacatttgaattatattctacgacttaaatttataaatggtaacgttgcgtacatagagatgttcgtggggtagaaaaaagaacggcagattaaatttgccgtaaaataaagagagatatgaatattggctcatcagctgagcacggctaggttaacattcatgagcgtaacaatcgttgaataatacataaagcttttttttctttgaactgttattataatttagttataaagattaaggtctgtttcaacattgatgacagtttaggaaattctgttatgaaaactctaaaattggaaatacccttttcaattatataataaataaagatattttttaatgatacctaccctagatgagcaaaaaaaaagaattatacactttctataaatctaagaagtcataatgtagtcgatgtaacaatattagatacctatatttctagaaaaaggactaacattaaataaaaaaaaatcgggtaacaaccaggtgaaagcagtcaaagcaaaagctgacgtccgaatttatctgaaggagaagaaactattatatacaatgtgtattgtgggctccgtgaacggaatgaaaatatgttgcgtaacgacatagttaatctgtatagtgatttaattagaaagtgttgacgagaagtgttcacataaatcttaaaaccttttaagaaaatgaaggtgttttatttctacatcaaagcaaatgaacattaaatttatgaaaagaggtatgaaaagtattaattcatgttttatttcagattataaacatcgttcatcattttacaaaactgtgtaaaatactaatggtagctacttttatcataaaacgttttcacgtttattactttactaacaccctaccctgtacatccgatctcagacttttttatgacgatcttatttccaaaagatgcaaattttttataagaatgacttttgtcttagaattaataatacagatttttctcctctgagcaaactccatccgtggacacactgtatatatttttatataattaatataattttattatcatttgtgaatacagtttttaaatactagcaacacacttgaaatttatttgtcctcatcagcaagagaccgattaaggcaaaaacgtcaatcatttctgagaatttagtgcctactattttgaaattatattataaattatatataaatacatacattcaccaacatagtgggtgacaaaaaaaaagaatttgatgaaattaaatcaggaaatcactcggcgacttttttcaagtcttcagtctgttttaagtcttttcacagaaaccatttcacttccttgtgaattagagtcttctgaaaacgtcatatgagatgatgaaaagtcggtggggccttgagagtcacttacagttgagaaacaagtattcgaatcttcagcaagactgaagttcgagtttgagttcgaagtatccagtactgtactttttctcatattctccttattatctctatgttttgaggatttttttgggttcatgactagttactggtacccatttatatattttcatagtagtgtctccaattgttacccatttcttttcccaatgccggactttgtctataacattcataacttttttaatatcatctttggccctactccgagtttctgcacgtatagaacgcgacatttttttctacaaagtgttttatactctatcaataaaaatgtgataatataacttatattat

SEQ ID NO: 105 - DNA, 2262 bp, Leptinotarsa decemlineata
  Annotation=B-cell CLL/lymphoma 7 protein family member B; Tribolium gene name from OrthoDB database=TC012275; Blast E- value Tribolium Gene vs. Leptinotarsa Unigene=1E-55
acaattgagcacaaaacagatatttgtttattcaaatcaataaactgaagcaaactgacagacaattgttaacacaagttcaatggaaagaatagttgagagagcaatcaaataaatatttaaaaaaaatattagatcaagtacacttgccataataaaatctggattattatagacctttttcagaagaagggcagttataaatcactcaatataagatagactggtttcggtttattaaacctttcttaagtaaacttgagtaacctgaaaagttcgtaggttaacacgcagatggcgctactatcctaaaattctataatagtatgcactaaattctcagaaatattgcattggaacaagaacattgttgtcagtttgtgattccatatatttcatcatattctatttaaatcatacacacgcagctaaagggctatagaataacgggcaatatgttttagtcattaatgaaatgtattcaacagcatcaatgtttattaaatgaatataaaacatttgaattatattctacgacttaaatttataaatggtaacgttgcgtacatagagatgttcgtggggtagaaaaaagaacggcagattaaatttgccgtaaaataaagagagatatgaatattggctcatcagctgagcacggctaggttaacattcatgagcgtaacaatcgttgaataatacataaagcttttttttctttgaactgttattataatttagttataaagattaaggtctgtttcaacattgatgacagtttaggaaattctgttatgaaaactctaaaattggaaatacccttttcaattatataataaataaagatattttttaatgatacctaccctagatgagcaaaaaaaaagaattatacactttctataaatctaagaagtcataatgtagtcgatgtaacaatattagatacctatatttctagaaaaaggactaacattaaataaaaaaaaatcgggtaacaaccaggtgaaagcagtcaaagcaaaagctgacgtccgaatttatctgaaggagaagaaactattatatacaatgtgtattgtgggctccgtgaacggaatgaaaatatgttgcgtaacgacatagttaatctgtatagtgatttaattagaaagtgttgacgagaagtgttcacataaatcttaaaaccttttaagaaaatgaaggtgttttatttctacatcaaagcaaatgaacattaaatttatgaaaagaggtatgaaaagtattaattcatgttttatttcagattataaacatcgttcatcattttacaaaactgtgtaaaatactaatggtagctacttttatcataaaacgttttcacgtttattactttactaacaccctaccctgtacatccgatctcagacttttttatgacgatcttatttccaaaagatgcaaattttttataagaatgacttttgtcttagaattaataatacagatttttctcctctgagcaaactccatccgtggacacactgtatatatttttatataattaatataattttattatcatttgtgaatacagtttttaaatactagcaacacacttgaaatttatttgtcctcatcagcaagagaccgattaaggcaaaaacgtcaatcatttctgagaatttagtgcctactattttgaaattatattataaattatatataaatacatacattcaccaacatagtgggtgacaaaaaaaaagaatttgatgaaattaaatcaggaaatcactcggcgacttttttcaagtcttcagtctgttttaagtcttttcacagaaaccatttcacttccttgtgaattagagtcttctgaaaacgtcatatgagatgatgaaaagtcggtggggccttgagagtcacttacagttgagaaacaagtattcgaatcttcagcaagactgaagttcgagtttgagttcgaagtatccagtactgtactttttctcatattctccttattatctctatgttttgaggatttttttgggttcatgactagttactggtacccatttatatattttcatagtagtgtctccaattgttacccatttcttttcccaatgccggactttgtctataacattcataacttttttaatatcatctttggccctactccgagtttctgcacgtatagaacgcgacatttttttctacaaagtgttttatactctatcaataaaaatgtgataatataacttatattat

SEQ ID NO: 106 - DNA, 3996 bp, Leptinotarsa decemlineata
  Annotation=Chitinase 7; Tribolium gene name from OrthoDB database=TC015481; Blast E-value Tribolium Gene vs. Leptinotarsa Unigene=0
tttggattttagtttcactcgtttagttccatatttgtcaaaatgattccacggcctacctgcagaatgagaactgttttatttatatgcatagtaacaattctcttagttcacctagtttctacagaaagagcaacgagaagaagactgcgtaggccaacaaaatcatcaatagctgccagttcaaaatcaagagatcaagaagtatcttctagcataacaaaattgagacggacgaggccggggcacagaaaaacttcagaaaactcgctttcctcatcttccaaagaaaaagatggctacaaagtggtatgctattacactaattggtcccagtacagggtcaaagtcggtaaatttactcccgaagatattttgcctgatttgtgcactcatattatcttcgcattcggctggttgaaaaaaggaaaactatcttcattcgaaagcaatgacgagaccaaagacggtaaagtgggtttgtatgaaaggattcagaaactgaagaaagctaatccgaaattgaagacgcttttggctataggtggttggtccttcggtacacagaaattcaaggatatgtcagccactaggtatgcccgacagacgttcatctatagtgctatcccattcttgagacagagaggattcgacggtctagatatggattgggagtatcccaaaggatctgctgacaagaaaaattatgtcctgcttctcaaagaattgagagaagcattcgaagcagaatcccaagaaataaaaaagaatcgtctccttctaaccgcggcagtcccagtgggtccagacaacatcaagggaggatacgacgttccagcagtagcttcttacttagatttcatcaacctgatggcctacgacttccacggcaaatgggagcgagaaacaggacacaatgctccactatactccccaagtagcgacagtcagtatcagaaacaactcaacgtagaccacgcagcaggtctttgggtgaaactcggagcacccaaagagaagatgatcatcggtactgcgacatatggaagatcttggactttggcagatccaagcaagcacggtgtacatgctgcggctagtgggggtggtaaggaaggaacgtattcgaaggagggaggattcttgacgtactatgaagtgtgcgagatgctccaaaatggtgcaacctactactgggatgacgagatgaaagcaccatattgcgtacagggtgaccagtgggtgggattcgatgacgaaaaatctatcaggcacaagatgaaatggctgaaagagagtggctatggtggagccatggtatggactgtggacatggatgacttcactggaactatctgtgggggagaagtcaaatatcctcttattggagctatacgagaagaacttttgggaatatcgagaggtaaagatgtgaaagacgtggattggcaagcgattgccggaccaaccgaagatgacgaagatgaagaagaggaagaggaagaagaaaaaccgaaacccattaaaatagcagtgtctgaagttttgaaacgagtcggaaaacccaataagaagaccacatccttggccaagagagtcaacaaacatgttcgaaaaccccaagtcttctgttacatgacgagctggtcggtgaaacgaccaggagctggaaaattcactcctgaagatatcaatccagcactttgtactcacatcatctacgcattcgcgactctcaaggataacaagctgacagaagcaagtgataaagatccagatatgtacgacagagtaatcgaactcagggaaaaaaatccggaattgaaggtactacttgccatcggtggatgggcttttggttccacacctttcaaagagctcacaagtaatgtcttcaggatgaaccaatttgtttatgacgccatcgaattcttgagggagttcaaattcaatggtttagatgtagactgggaatatccaagaggagctgatgatagagttgcctatgtcaaccttctaaaagaactgcgactagcttttgaaggggaagcgaaaactagtggacaaccgagacttctgctcactgctgctgtaccagcttcatttgaagctattgcagctggatacgatgttccagaaatctccaaatatctagatttcatcaatgtcatgacttacgacttccatggacaatgggaaagaaccgttggacacaatgcccctttgttccctctggaaagtgccaccaaacatcagaagaagctgacagtggattactcagctcgcgaatgggtgaaacagggtgcccctaaagagaaattgatgattggaatgcctacatacggtcgcagctttgaactggtgaacatcacacaatttgatattggagcaccagcaagtggaggaggcatagcaggaaaatatacatcagaagcagggtttatgagctattacgaaatttgtgatttcctgcatgaagacaataccaccttggtatgggacaatgagcagcaagtaccttttgcctatagggataaccagtgggtaggattcgatgatgaaaggagtttgaagacgaagattgcttggttgaaagaagaaggtttcggaggtatcatgatctggtctgtagatatggatgacttccgaggatcttgcggtagcggaaagtaccctctaataaacgcaatgaggcaggaacttgaaggttataaagtcaaattggagtacacaggaccgtacgaatcgagtgtttctactggacaatacacgacgaaaaatcccatcgaagttatatgcgacgaagaagaaggccacataagttaccatcccgacaaagcagactgcaaaatgtactacatgtgcgaaggagagaggaaacaccacatgccttgtcccgccaacttagttttcaatccagaccaaactgtctgcgattggccagaaaacgtggcaagctgttcacaatttacacccgcacctccaccaagttaacttcagtctgacttcaaagaaagcgatagttggaggttactgtcggataccaaggatttccttgcaaaaatcaactagattcagaagattttggtgtcgtgttagtttatccaatgaacaaattttcaattctgaaaaatatcggttgccagtgcgacggcaactgagcatttcctaatcaggaaaaaacaattgactttattcagtcaccatcattatcttagtttggaatataatcactaacttctgctcagattatcgctcacaatattgtcaccagaatcgtcttcacactaaattgctatgattctttcagaaaaaagctcattatttctctcttcatttcatcatcaatatttgtcacaatttgcagacatctagattcgtatctatttttcaatttcatttatctttccgtatgtaacttgctaatattcttctgtataacttttcatttttccactattattgaaattattattgctaaagaatgaaattgttcatttgatatattttgcctcattccaagatatctctaccttcaccaattttaatgattttcttctgcctatagttaccaattcttccccaccaaacatattctatttctttcattgaattttttgtatagttttgttgattatcaactgaaatataaccgatggattttttccacgatttcacatctgtctattattttatcatgattttactttaagtgacatccagaaatatttatttcattgttgatgacaattttttaggctaattccttcaaacctgttgagggtgaatatttctaacaatttctttcagttttcaatgaaaattgttctgaataagttgcagtttattgagtcatttaataatctcgtgaattcctgatagatcgtttaaaaaaatgaaaagtatgattttcattgttttcgaattcagaaaccaattttaaccctggaaaaagtcttgcttgacattcatctaaatgttgatgtaagtaaatga

SEQ ID NO: 107 - DNA, 2322 bp, Leptinotarsa decemlineata
  Annotation=5-aminoimidazole-4-carboxamide ribonucleotide formyltransferase/IMP cyclohydrolase; Tribolium gene name from OrthoDB database=TC004437; Blast E-value Tribolium Gene vs. Leptinotarsa Unigene=0
gtagtaggttacgttaggatagataggctacatctatcaatttattgaatattctcagatatagaaagacaaaatgtttctgtatatcactggttgaaagatatgaatttatttttcattatcaaaataaaactgttaaaatggtctttcttcttgctcaaaaaatatttttcttcaaaataaggtctttgaaaaacacttcttgtaaccaatgttgaaataaaatgttcatcaaactatataactaaaaaaattattattttgaatatttttcacatttctcttgaatatattccagaaaatatttttgtacatatatttttttttcattatttgacaaaattcgtatataacattagtacggggcagttttcgaaaacaaaatattaatgatggaagagacgcaaattagtatgtgccataacaattttatgttcattacaagctttgatgacctcctcatcgttggtggatcctgaaggactggcaatgaacaaaactccgctttgccttgctctgtcaatattgtctctgaaagggaagaaagcgtcagatcccaaagcgactccagaaagttgggtttgccaggctgcacgttcctcttggttcaagtccacaggtacttcctcgaacattgattcgaaaacaactctgctcatatcttttccaacattaccgttgacaaagttatcaatagcgttagaaatttctgccctcttgactccttttttgaacttcataccaatgaccctagggtgctgcctcagccaccagttgtctgccttttcaccagctaaacgagtgcaatgtattctagactgttggccagccccaatgccaataacttgtccatctttagcatagcaaactgaattgctctgggtatatttcagagctaccgtagccacaattagatctcttatagctgactctgagagatctttgttttcagttactacattactgaaaagagattcgttaatcactgcgttatttctgtgttgttccagagttaaaccaaaaatcatctttctttcgatgggacttggagtgtagtcaggatcaatctgaagaatgcagtaacctccattcttttttttcttgagtaactccagagcttctgggcaatatccaggtgcgataattccatctgatacttccctggatatgattttagctgtggagtagtcacagatatccgacagagcaataaagtcaccaaatgatgacatcctgtctgctcctcgagctctagcatacgctataccaagtggggaaagaatttccaaaagatcatcaaccatgcacaatttcgcctgctctgggttcagaggaataccaactgctgctcctgctggtgaaacatgtttgaagctagtggcagcaggtagcccaagagcagttttcagctctttcaccaactgccacccatttaaagcgtcacataaattgatgtatccaggagaaccattaacaacagttaagggtagtctttctaactcggtatacaattgtgcaggtttctgatggggattcatgccatacctcaggctaatttgagatatattcctagagtattgcttgcgaaagtaatcagagatagccgaatcatactcagaggtgtgtgtgaatgctttcaaagccagggtttgcctggttttaatactcgtatcaccacttggattggttttcagttcattgataaccctggcatagtctgaaggatcgactataacagttactcttgaatgattttttgcagcagctctcaatagggtaaccccaccaatatcaatattttcaaccgcatcatccactgtaacattctccttcgacactgtctccacaaaaggatacaagttacaaactactagtcttaccatctcgattttctgtttcatcaagtcttcttggtctgaaggaattaatctagctaaaattcctccatggacggctggatgtaacgttttcactcgaccgcccaggatttctggggctcctgatatttctgaaacatctttaactgacagccctgcctgtctcaactgtgttgctgtgcccccgctaccgaccaacttgaaacccaagctattcaggttctttgctagttccactaagccggttttgttggatacagagagcagtgctatattaccacttgttgccattgttttattataatacaacctcggttttaatatattgatatatgatatattgataatagatgctccaaatttcacgttcgtaaaagacaattaaccttagaaactgtaaacttagttaaggttatgtcactctgtggttttggctttttccacc

SEQ ID NO: 108 - DNA, 3191 bp, Leptinotarsa decemlineata
  Annotation=Protein phosphatase 1 regulatory subunit 12B, putative; Tribolium gene name from OrthoDB database=TC003209; Blast E-value Tribolium Gene vs. Leptinotarsa Unigene=0
ctaacgatacatgcctatatttcagaagttagagtcacaatgtttctttggactagatttaatgaattttctttcgaagtataatacaatgacaaatgattttcaacacatgaagacaataaatatttctttaaaatcagttacaatttcaagacgaagattagaacaaatatattagtttgaaaataaatatgttacatttagtataaactaagtacaatttcattttacaaaaatatattttgaacagctcacatatgtgtaacatatttttcgtaataaaaacagagaggttatgaagcttacagtatctatctactcatctatatataaaatacaaagtctacctttaaaaacgtaagtataatgtaagtaaaaagtaatttaggtaggttaaatataactaaaatggcaatgacagtactaatttaagcagttatatcacacattagagaaaggaaaatacgtaacaagaaactttttaaattcaacatattttacgcacctaattattcatatacactacatacttatatgtcaataattaataaatacaaacaataatactcagttgtaaaaaacttgacgaaattcgttcctatgtaatttttcaattattctaacaaataaattatcaaagtcatccaacataaaatgcactgaaatttaacagctaaaatctatgctacttagacagtttactgatcactctgatcagagcaccgttctcatctttcaacctctggttttcggttcttaaattatccaagttctttagctcctcttccatttcgcttagttttcgttccatggctcttctttcgcgtttttccagttcggataacgagtttttactggtaaccagattgattttttccaaagtctgtttagtttccctcaattcttcgtccgatttccttaatttgtccttgagtctttcattctcgactagttgctgttcatacaactttttatagtcaatttctccattttcgtttcgaatgtcggaggtactacttatcctggatctgctgcttctgtctgttccactctcataatgatttgttttgatggtctcatcacagtcttttccggttgtcggatctttctcctgatccaagtcgtcaacattgtcaaacgtcacaacacccgttgatcgtctcttaggccttctccttctgtttatagcagcttgggtggcgagagtagcattcctaatgtcattctctttatcttggtctttttcctctacagactttggctttctcagcggtagtgttacggtcgtcgtgtccgccgtttcgggaggcgcagaagacggtctttggactaggttcccggtgttcgttctcctaatgaatgaaggtgtactaggctgttcggctggtttagttgcatcctccaatttgaacttgctcgagccgtccaccttcagtctccaagaaggtctgcgttcatgcacgacaggtggctcttcgttttcgcgagttataaccgtaggcgtccctgttgttattgtagcagtaacgaccactccattaggcgaatcaccattagaacccggcttttcattgctagtgggctggccctgcttcttgaccgactgctcagccgattttgaagctgacttgatttcctccaacgtgacgccctgtgtggatctacgcgtttcacggactcgcttagcatgtgccttcctttgagtttcactctcttcgtctcttacgggtgggacgaaggaccttcttaggggttgttgattcgtgggttgtggacttgtgacaggtgaagttttatctggtgaattatttgtggcagcggtgatgttaatggaaacatttttagtttcggcattgtcttccttactggataatttttcattcggtgaactgggtattttcctaagcgttacttcagtttctttagacgtttccaaagaatttgtcaaattattgctaacagaactcttaactggacttgtcaattcagcagtttctctgggaggttttttccaaggcagattgtcctctggatcgtcaacaattttttgagtcagtgccgatgatgaattcgttgtttctacaatgggactcaccgcgttcaatttatttttcttttcggtattttcgttgacctttggttcgatttcattggaagattctacttttttaactttgcttggggtctcagattccaaatttctatcacatatgtcaggtcttttcattgccattcttctattgaaaacgtcctctttgttttgtttcttcttgagaccttccaaataggacaacatgtcggtatcgcacaagtcaaatgcagtttgtcctacataatttttggcttccatgtcagccaacttttcagccagatactgacatgcttctttttggccccaatgggcagctgcgtgtaaaggagtccatccatctacgtcttgtgcgtctatatctgctccgcattggataagtatttttaacacatccatataacctttagctgcagccacatgcagagctgtagagccatttttggggtgtggttcattcaccaaggaacttttagtcgctaaccaatctttggcatccctcaacatgatcatctcctcttcgtttcgagctgcttcacaatcaatccctctttcttcgatttcctccttgagtaaatcctccatcttcgagcattccgcaatatcgagcgccagttcgccatcattattgacagcggcgacattggcgcctttttcaataaggtattttgcgatggataaaaaaccgcaactggctgtggcgtgaagcggtgtccaaccctcgttgtcgcctctattgacgtccgctccattctcgacgaggaattcgaccatgtccagattgtcgtcaatgcaggcctgatgcaaagccgttagtccatctacattggcagtatcgatgtcagcccctttttgtaaaagtttgagcacttcgtccttatcaccagcagcacaggcagccaaaaaaacacatcccgacgaaaattttatttttcgcgtattatgtttcggcgacactggctgacggttcgtatccgattcttcccaacgttttaattgttcagctcgtttaaaaagggccgaagttgatctagtctccagcgacatgattatttaatacctttacacacgttccgtcaccattacaaataattatagcaat

SEQ ID NO: 109 - DNA, 4227 bp, Leptinotarsa decemlineata
  Annotation=Tetraspanin, putative; Tribolium gene name from OrthoDB database=TC030562; Blast E-value Tribolium Gene vs. Leptinotarsa Unigene=0.; Blast E-value Tribolium Gene vs. Leptinotarsa Unigene=0; Blast E-value ...
  ...Tribolium Gene vs. Leptinotarsa Unigene=0; Blast E-value Tribolium Gene vs. Leptinotarsa Unigene=0; Blast E-value Tribolium Gene vs. Leptinotarsa Unigene=0; Blast E-value Tribolium Gene vs. Leptinotarsa Unigene=0; ...
  ...Blast E-value Tribolium Gene vs. Leptinotarsa Unigene=0; Blast E-value Tribolium Gene vs. Leptinotarsa Unigene=0; Blast E-value Tribolium Gene vs. Leptinotarsa Unigene=02
tccttatcgtaatccctcagacgaattagatttatagtgttcggagttgtgtacattgatttgaattttcaatgtaattgaagaaacaaaatagttatctacttgaatttcaacaatttgaaagatgggagctggatatacatgcatgaaatatctcttcatcgttctcaatataatatttttactctttgctgttgctggaattgcaatctcaatatggatgtttgtcgatccgaccattccgttgcatttcacacaggaatcaaaggattatttaatttcaacaataattcttcttctggcctccattatcctccttatcttgtcgatcttgggcatatacagcgtcagtagagaggttcgaaagtctttagttttgtctttctgtcttcttctgatcatcgttgttgctgaaatagcagtcggagtatggggctacattaacagagatagcttggagtctcatatccgagcttccgttaaatctactgtcagagaggattacgataaggatgaaaacattaggaatctgtttgatacaattcaaatgaagatgcactgctgtggagcagaactacccacagattggagtcgcggtaaagaattcaatatggtaatatcaggtaatccgaacaagtacaacattcccgaaagctgctgcaagactggcttggaacctcagaaatgtaccaaggccacccaaggagtcgaaattggtgctgacctcgataaaaatgtcatttacgaaaacggctgctacactttgatactcaacaagctgaaggatagcgtttgtataattatgatagttggaggagtaattctggcagttcagatcctcggtttgttgttaggcttaatattagcatgttcaatgaacaggtcgcatcgttacaaaggttaaaaaaggttgacagattggagaatattatctagttgttttttggaaaagttttgttttgaatggcagttcacaacagttttgtttcactatttcttgggagtttaatttaattggcagaattattttccacttactctgcttccattcttttttcaactgatttttagatttcagctcgaaacaactttgtcaagaaaacaactagatagttgttataattttattaatcattctttgacttacaaatatacgtacaaataacttaaacaaattgatagttatgtttttagttagacagatgctttattttctgatgaagtttaaaccaaaaatcattatatattctatgaaacattttactatactttaaagatgtacacaaagtttctaaatatctttttgatgtatgtgccatatttatatttagatgcaggtaatccacaaaaatcgtattgaaactttcgtggaacttgtatattcttgatatttagtcgtaactttactcgaatctcgaaggactctcattatttagtttcataaattaaccagaattatttattgttacggatgtgttgaaaaatttaaattattcattaatttttactaagtacttcacatcactgcataattcaatttattttactcatcttattgattcgggaatctcaagatgctgaaaaggggaagtccaactttcccgttttcatcattgattaaccatgacatgaaaatttgactgatactaataattaagaattaagttatttcttttactttgcactgcctatttttgatatttcccatttcatcatggacatgctctgtaacatttttattctctctttttaactgaaatgggtaattagttatttaatattgcagagaatcttttcgaaggtttatcaaccaatgcttatattttttgtttttggagacttaaagctgatagctttatgatttctattcctatctgtttcttgatcaatatgtgcatttcaagaactacaatgtaggaatgtgtttctgcaggtttgcctcaaacatataggattattgaagtgattatgaaaaactacctataacaggaagttaaatgtaattctactataattatatgattgtcatcatcttgctgtcatgtacaaaattacaagccaaaattcattctttgaaacaccaagtacttttgttgaattatttaaattgttattgaaaaacttttaagggccgatccaaacttttcatttgtgatgggcataatcaacaacatttgaggtaagcagctaataaatgtatacttatcagactttacatatacgataatatgaaaaattatttgcactttaaccttgcccttatttcagactgattgaaataacgtgcaacggccgataaggaaagaatgttagggtgaagtgtaatttcgatgacaccgtcggagaccgaaaagaacttcttgctgctatcaatttgtaatttttgtcattgtattctggttgacaggcgctataaatatatattgaaaaatactcaaaatgggatttgacagaacaaccctgttgtttgaaaaataactaaatttttattaaaaatacaaccaaatctcaagggattcaaaatatatatgtctgaatattgagatcaatgagtaacctgtttcatttctagtcttcttctaccctagtctattctaattgctcatttcagtgaattgctaaattgaactaagtttgtatctttctaccttatacgtcactgtgcatgaacaatgtttagctttacagaatacatgtaaaagtagttatagtattgcagtaaatcgacacatagatgtctaacaaaaaaaccgcactatagattactgataattccctgacaaaatatgttgtaggctttgatgacatattttatcagttctcgagacttatgtagatgtgccaacttagagaaaacgttaagtaaatcatatcatgaaagtaagcattgcatcactgtttccccagaaatgttgagatgtgagatagtcggctgaaacaaaacaatcatatcagagattgtgaccagtgacgtcaatctgggttagttttttatatttaccttttgttaagcaatcggactgattttttaaatttatttttttttactgttcaaagtacttttttattaaatagaaaaaattgtcatgcagtagttttggagggtaactaatgtttatttttgtttgaaaaccctagctaaggatctaattcttttagagcttcaaaactacttgaaagcatactctctgtcagtcttatttcatttctaaaatattttgaatgaaggcgggtatacatcattatagctcaagtatgcttacaattttcatccaagcctttttcatgctcaactcagacaattttactgatatttattgtcacaacttatatataaccaaagttagaccgaccacctaagttttttattaatttttttatttgattatacatgacaattatcttttactgaaacatcatagcttgcgtccaccagtttccagcggtcaaagctgttttaccccggaatatggtaaacagtatttgctgaattcagccactgttaaatctaacagttaacagttcttattttgtctacataaatctctgcaccgaaatttgaagactagattaataggaacgaatataatgaaatctcaatcaactgagataacattaattttattgattcaagaagtaatttacaccactttcagcgcagtgctttctgctttttcgtcctagacgcagctattgttattgaatgtaaattaacctcactttttattaatttacttacttatgcaattgatgtatatctgctttgaaatctacgttgagttaatgttgaacattgctgaaattctctttgttgtgtaaaaaaaaaatctgataaatatatttataaattacatatgttcaaaggatttaaatgtaacgaagtgcgtaagatgtttatgacacacagccagtaaatgctttgtaaccaaatacatatagactgaactgagaaatgcgttctagaacatacactcaatgaatttatctcacagagaaagacaaaacagattgtgtaaatatatcttattgtgtggccatggttttggccgtttaggaattgtgatgcatgtttctatttttgtattcgattcaaattgaatgttttttttttagtttgacatttgaaatgaaatatatgaacagcgtctaagagatatgctgatttttttatcctaataaagtactaatatttgtggtattatgttgaaatttatagatgtttgtatt

SEQ ID NO: 110 - DNA, 1576 bp, Leptinotarsa decemlineata
  Annotation=SH3 domain-binding glutamic acid-rich protein homolog; Tribolium gene name from OrthoDB database=TC014808; Blast E-value Tribolium Gene vs. Leptinotarsa Unigene=1E-61
agcagttggtattctaacgtctagttagtttacttttttttttttttttttttttttttttgttctatcatgtcaaaagtaaaattatactttattttataatattcaatagggaaatataataaatatttacaaaatccaaaataagaataacagtaacatacaaatatatatgcaacaatttgatcgaagcaatacaaaaattagtaccttatccatagtttcaagtacaattttcagcaaaagaaagtgaagccattcatgccaataaaatgataaaagctatgaaactaacgaagataaatattgaaaaaagttctgggttatgtttgaattcactcaaaattcattacttacgaaattattctcaaaaaggggagattcataaatgtaacttaaaagatggaaaacaaatttaatttgaataaaaaccgtttcacacaattttaaataaagttagcaattatatataaactactaactttttccaaccctccagctccttgtgagatttttgcaacttctctgtactttatcaaaacctcttcgttagtattttgacttattatattggctatgaataaaatgaaaaagaaatgaaagagttcgcgagaataaatatttttaggcaaaaaaacgccaaattcaaatattccgatgtcaagtttagaacaaaaaaagaaaaactcttcaaaaattcaaatgaaatattgaagaacattgaatttgggtgtttaaaccattatcttataacaatataaatcagtgcatattataaaaatatctttagagaaattattcatcagccttttcgggagagatctctttcttccattcttcttccaatttttccgatttttcaacattttctatttgttcatcaccggcaccgttttctttatgcccttcattttcttcttggtgttcttcctttttttcttggtgctcttcctcttcttcttgattctctcccgtttcttcctggtgttcttttgattctacagaattaatctcatctaccttgttttcatctacttgttgattaggcactttgttttctttcaattcctccgtttccacttcatgttcctgagtttctacatctccattctttagatttatttcagcagtcgaaatttgttctttagtgaaatcgctggcttccaacttcagaaatttttccatttcatcaatttcattggccatgtcaaacatatcataatccccacagtacacatcattattgaaaatctgaggaggtagaggatgtcttgggttggggtcgctaatggtccctccttgaccggttgagttcgtttgcataaaatctttagcttcttcagctcctggttcggcaatatcaatgacttcatacttgacattcttagaatctaggatcaaaagcaccctttgttgtcgtttcttcacctctttatttccagatataccactaatataaactttaatcaccattttgggttatgagctcaattttataataaaaaaatctaattaaaataatactatttgacaatgacagataacttgagagaattagtgacactcctattttgtc

SEQ ID NO: 111 - DNA, 4863 bp, Leptinotarsa decemlineata
  Annotation=Neurexin-4; Tribolium gene name from OrthoDB database=TC011252; Blast E-value Tribolium Gene vs. Leptinotarsa Unigene=0
gtccaaacgtgtccagctgatatctctcttacctggtggagcaaagtgaaactaatttggtgatggttaatcttcgggcaacgtgaaaataatttggaaatgtcaaaactccagaaacgtaagaataattcggatattattttccagtaatgaggaataaattgtcggatccagcaaagtgaaaatacatgctactgcatcttggaaataaattggaattaggtattgtactggaaacgtgaaaatcgagagtggatctattccggtaacttgaaaaaagtgtaacttagtaatgctaaaaatttgttcaacactttatatgtaaaaagatatacaaataattagattacatacattagatactgggtgtgacctataaaatcagaatatttgaacaatataccaaagacacattttttttaagtcaacctacgagagaattcacaaataaaaattaagataaataaaaaatggacggaaaataaccacagaaaatcaaaataaacatgtaaacattttggtgtaatgaatataaaaaaaaactgatttactcataatctcatacttggaatggttttaaactgaactatacagaacgagaatcgacaaaaaaagaattttttgaatgccagagtagcttttcaataggaaagcttcataatttataattttcattctgtataagtcttcatattataactctggaagctttggttcaacagaggaaacacgattgtgataagtactcttaagcagtgttctttcgaggatataaattctataattgaataagccacggtcggagcaaatttctgcttcgttcaatattcaactccgttactgttgagcctccgcatccaatctgccctaaatgtgtgtccgaaactaactttattacatattcacttgtactattaggcctcgttctttccgacggtcgcagagctatatgaaccactccttcttcttctgaacgtggtgacccgtcgtgccgtgcaccactgccgtatccggatctagagcagagtcagcgccagcatcctcttgtgtcaaatattcacccttgtgtcggtgcaagtacctgccgatgatgatgagcaggatgatcagcgctaagaaaacgattgccagaacacttcccaaaatggcagaatcgacttggttgtaagctttcctcaacttgtcgggatcgacactgagtggcggcctcgtctcaacaatgtcgggcgggtgcgtgatcggttcgacgccgcagtaatcctcagtcaatggagttcccaaagacttgacgttgccgggcccctgctgctgaaacagcaatttcagtggatagatgtcgtcgaactcgaccctggagatgcacccgatgaagccttccgtcatggactcgttcttgccgatgtacatgtactggatgttgttgaactgtgcgtcggccgaggctttgatgttgaagttgaactctttcggctcgttcccgtccacctgcattacgagcgtcgagcctccgttcttcctcgagacgatcaggtcgtggtactggccgtacccgaagtacttgtcagggtagtgtacctcttggcgctcaaagccaaagtcgaagacaatgcgcaggctgcccgagttggacaccataatggtcatgtattcgcccgtcatgtttgacgtgaagcccagcagaaaacctttggggttagtggtcgtgaaaccgacgcggatgtgctcggaaatggtggatcggaaggaaccgtcaaagtcgtatctgaccatggaactttggcgcatgttgacacctatttcgtctgcacaaatggggcccttgaaagccgtccaccggcagtcgcacatgtagctgtcatacctttcgtggcaggtgccgttgttcagacaaggattgctctgacactttccgacgcacccctctgcgacgccgtagagccccatgcgcgcgtactgccttagatcgacatgcttcccgttgatcagcaaggccctgatgcaacctgtgaagccgtccctgtagtccgtcgccgctccaataatcagctccgaggtcaggtgcagggctcggacagggccgggtggctcacggacttccgctttcagagcgccgtcgatcactatcatcgcctccttccggttcctttccaccgacaccgaatgccactggtcgtcattcaacttgtaggacgtctctctgataactgccatgggccccgatccagcttgatattcgaactgcagctggttaccattaacaatactcagtttgatgtgatctgttggccccgtcgaatggaacaagacggcgtcttcaacggcggttcggaactcgaaataaatatcgccgctgtggcccatatcgaaggtcggtaagttgatggtggcgtcggatgttcgaaacgtcaccacattgtcgaagagatcgtctccttcgcatatcaacggccccagcgtgtagcggccttctctctcatccagggcactgccagtatcgccgaagcgtagctgttttacaggaaggtcgtctttttgtataatgtcaccagcatctacttgccaaacatcagatccagcgtcacaattgcaccatttagtcgggtccgtgcaggtgccgagaactccacagtcacacattctcgatcccgggagaccaccaccccagtaatccatcttctgattgtttcttgatacccaccacgaatatggcctgaaattcatctcctccgatggggaccccatcagcctggcccccctgcacgcatactggatgtgctgtcggcaagtcagcgacctgttgatgagcgcagcgatctgatcgtcgtcggcttcgtagtggatgtcctgcgagaactcgcccggttcttggaagccatccacaggggtagtttcctcgttgctatggtggaggaaggtggcgactcgcccgtccgcatagaactcacacgtgacagggaacgcggcgaggggtccgctgccgtcgacgtcgatcttgatttctgcgcgctgcccgaccgcttgaacgttcttgtacgccaagcaggagagagagttgatggaagtgtggcagaccgctcctccatagccggttcccttacatacgcagaagaactccattgaattctgcttgcacacgccgccatgctgacaggggttcgggttgcaacggtccgtcatttggcaggcgtcaaacaccacgtcctccccacagcagtattcctctttggtccagtccgtgggcagcttgttgttgccgtcaatgcgtatggtcctcatgcatcctacgaagccggggaatatggtgttggagtagccaaggggggcgttcacgccgcccgcgatcaggtacagagagccagtcacgatcttcaggaggcgcgtcgtcatcatgggccgagaatcgacgttgaagacgacttgattgttcgagatcgtgaggacgaccgtgtgccacctgccgtcgttgaagtgctcgtcgtagttgtcgaataccactttcggattgttcggggtgaccaactccactttcagtttagctcgttccaagtagatagcaacataaccattggtagaaaaggcatgataaagcatcaatccattttcttcaaatgttctgaacgcgaaagaagaattaagagaggacattccttcgtagcccttcaattttgcgaaggaatgctgagtcttgaacgtaactggaatgatttgaggttctgggcaactccacagggtattgattttttcatatttgaacgtttccccatagttgaacgccatcttgacctcgctgatgagatttgtagagttcaagtataagttttcaatgcaacctgtatagttctgaacaactaccaagccctcttgtatgttgggaactccaccaacgtaaaaccctctgttcaagttcagtcgctgaaattcgcctttgattttatcatacacaaccaccctgtcaacagaaaacaaaatatccctcctattcctggatatcacgacgtcgtgccataagttgtcatccaacagactcccaacgcataagctggtcaccgttccagagcctaaatctatattcaaaagcatcctattgtcttgaagctgcaaagctatgtaatccccttgcgttcccctgctgtagaggacaactccgttcggagcgctagttttgaatctgaactttatgctctctttcagagccgaaattggctctctcagtagatcgtatttgaggagagaggttccgttgaaatacatatcgtccgcctcgtaatcacaaccgaatagttcgaccctcagagagatcctgtctctccatctcgttgggtttatcctgatccattgagcaatgattggaacttcaaattcatttttgtggaccgtgtctccatctacattaccccgaaacatcatagtatctccgccggattctttgtaatttgcatagtcgagaccgttggtaccgtaactgatctgatattccataacgtactcgttactgtgaggcctaccttgagtccatatccttgttaggttcattacttgtcccaggtcaaaaatcagatactgatcaaagtcattgtccttggagctccatgcattaccaccatataaaacagcattttctggtccccttccactcatagaagaggtagcacttagtgctgctctagtgaaaagaggggtattgcattcgtattcatcgtaatattgtgctgaaattaaattagtggaaatgcataaaaataaataaacatataatgccaccatttctacaacatgacaacacacacggcacaaccccaattttatgacggaaaataataattttagcttcaacttcaaactgttaaaaaaatcactagaatc

SEQ ID NO: 112 - DNA, 2328 bp, Leptinotarsa decemlineata
  Annotation=NADH-cytochrome b5 reductase, putative; Tribolium gene name from OrthoDB database=TC005424; Blast E-value Tribolium Gene vs. Leptinotarsa Unigene=4E-179
gagagataagaaatcgagtgtcagtggcacaatataatgaaaaaatgtatcatagtggtaagagatttttggtgttcgaacccggggaagaagtgacagtgcgggattaccgaaaacaaaactcgagagagtggataaaagcggaaattgtaaagaaaattggcaaaacaatatatgtagtacgagtgccagatttagatacctacaaattttgcgtgcgatagtgaagtttaaattacgagtccgatttcaccaaaagaattacattgtgtcactgaattctccgtatactgagaagctgggaaatcctcggaataaatgtgccctccaaccaggacattcccttatggattggatccgtcttggagcctccgggaaagatcttacaggtgtcggttctcaagcaggacgtctttcggtgacaaaaagcgaattagcaaagcataataagataaacgatatctggttggctatacgggggagagtatacaacgtcactgcatacataccgttccatccaggaggtcctgacgaactcatgaaagcagcaggagttgatgccacaaagctattcgaccaggttcatccttgggttaactacgagcaaattctgcagaaatgcttcatcggtaggttggtttcaattgatcctggaatcaactcgcaagatcttttcttcggaaaacaagcaactaaaaaatcattcccaaacaacttcggagaatccaaaactccgacagttgaagcagttgcgaagaaaactggagctgagactccaaaaaagcagcaatcagtggcgaaagtggatttgtcaaatgctgaagatgagctggaggaacaaacagatgttgttagtttaccaaggtttgattggatccaacaactgaactccataacagttattttctacactccggccttctcgaacccaatggtggaggtgatccctccagatgcaaataaagcaataatgatagtaatttccaatgacgagactatttttaggaatgaaattgttttttacgaaaatgtagtttggccttgttttattagggtgacatgtgaaacaggaaaggttgaagtgatttttacgaaatgcgaagatgcgatttggagtaactacggggttctgagacagcaaagtgaaagtgtcgaggctgtgactggcgcgagatacaatcatgtgtttagcgataggataacagtgaaccataatatctatctaatcaagttgaatcggactgatggaaggaaaatcgtggtgccaattggaaagcatgttagagcgtttgcgaacattgatggtcaggaatggtctcgaagttacacaccggttccttcatctctcttcacaaatctttctctaaacaactatacttcggacacggtgtgtctgatgatcaagcggtataaaaatggcaatgtcagcagattcttgacggacagagaggaaaacgacgtcgtctatctcactggtcctttgggtgacttcgatctgagaacgattgagaaaaaggagacgtttcttctgcttgctgctggtacgggaatcacgccgatgttttcgctactggtgttccttttagaaagaaggatacgaaagtgtcagttcgtcaggttgctgtttttcaacaaaactcaacaagatataccattcaaggaccagcttgacaatttgcaatcaactgattctcggttcaaaatagactacatcctctcgaccccagacaaaaactggttgggtctgcagggtcacattaacaaagacatgattgaaaattccatccttgaacacatcatggacactggttatacgataaaagatattttcactttcgtctgtggaccaaaccaatttttgactatcgctctggaagaactcgagaaaataggaatcataggcgaacaaatctatgtttttcagggatagcagaagttacagggtggtggattagtgcacagtgagataaagtcatctgatgattcgttggttgttagaaatgttaatgattttgtactgaatgtattcaattccattggaaaaaccagggtctgttaatatattatttcattcaataagtttattgtttgatactctaggctgtcattagccataaagaagattttattagatttaatgttcattccaaggtaaattgtctgaacattcacaacaaacagtaaatcatagtttatcattatcatagtatgcacttcagtttgaagaatgtcatcaccccgccaaatatcaaaaaataatttttcataattaatttgatggattatttgaacaatgtgattctattttatgtgatatggttcattgaa

SEQ ID NO: 113 - DNA, 1456 bp, Leptinotarsa decemlineata
  Annotation=Lysosomal acid lipase, putative; Tribolium gene name from OrthoDB database=TC007264; Blast E-value Tribolium Gene vs. Leptinotarsa Unigene=1E-52
caataattgtattagtcatgttttgaaaataatattgtgtcacagaataatctatttaagagttcttgaaatagtatataatgattaaccttccttgacttttctgcaatgaaatgataaaacattcttgttctctgaaattctctataagatgttattcaaatcagtcatattggttttgggcattttactcagttcgcaagcagaagaatacagtgattgcagtgtctttgccaagtaccttgccagtgaaaaatattgtgcttataatcccgatacatatttagatgtgccccaaataattgccagacatggttatccgtcagaaacccatgtggtagtcacagaagacggatatctattgaaaatacacagaattccgggttcaagaagtggaagcagaaatggacaacctgtttttcttcaacacggccttttgggtagtagtgcggattttataatcaacggaaataaatctctaggttttctgcttgccgataagggttatgatgtctggttgggaatgcaagaggtaatgtttattcgaaaggacacatttcgattcctgtaacagattcaaatttctggaatttcagtttcaacgaaatgggtactaaagatttaccagctgctatgtattatattagcaattcgacaaacaaacctggagaaatcatctacgtgggtcactcaatgggcaccacaatgttcttcgtatttgcttcactaaaacagcaggcagcaaaaaatgtgaaaatcatggttgggttggcaccagtagcttatgtgtctcgcatgaaatctcccatcagatatttggcacctttttcaaatgattttgagtggttgacgaaatatttggggattgatcagtttttacctaataacaaaatactcaaactgctgtctttccaatgcgaaatatttaaaatcgacaaaagtatttgtgaaaacattatatttgctatttgcggattcgacaaagatggattcaaccaggacattcttcccgtagtgttgaacaaggatcctgcaggcacatccaccaaaacagtgatacactacgcccaagaaattaaaaacaatggtaattttcaacaatttgactatggagaggaaggtaatatcgttcaatatggaaccaaaaatcctccaacctataatattactagtatacgaagaccgatctatttgatgtactcaatgaacgactggcttgctgatgaagtagatgtccttcgattggcaagtaaaatcaagaacttggtcggggcatacaaaatcaaaaggaattcctttaaccacgttgactttgtatttggaaaatatgctgaagaactggtatatattcctatgctcaaagtcatccaaaattacaccgaattttaatagtaaggagtttcaatacaagtgattattagtttatgccaggtagagaaataaagttgttatttct

SEQ ID NO: 114 - DNA, 3222 bp, Leptinotarsa decemlineata
  Annotation=Anarchy 1; Tribolium gene name from OrthoDB database= TC010901; Blast E-value Tribolium Gene vs. Leptinotarsa Unigene= 1E-1; Blast E-value Tribolium Gene vs. Leptinotarsa Unigene=06
tataccccagtgtttgtgtgtgatttcgacatactggtcaaatatataataattgtgttgtattttcgagttccttagttttcatatttacccgacagtggataatttattgtgaatctgggaaaaagtgcagtgccaagtatggagaaattcttttggaccttgcttctggtgaacgtcgggatagttttcgtaaattccgagtcgacagttcattttttagcgggaaacatggaacagttcgtgacttctacgacgctcgaatgggtgccaagagtgccaaggaatgaaaatgacaaggaaatcctcaaaaatgcagtcattgccgcatatcaagttatagcagaaccgaaggacaatgaggcagctgtgacagaaaacgacactggaaacggtttggttagcaaaccggtatacgtatgccgagcaaaaatcaacagcgtatgggtcgtgggtcagctcaggcccctcaagcacgtttgcgtagtgtccgactacaggagggtgtcggaacacgaccacttcgacatcttggtgagcatcgaagatagcgccaggctcagctgggttaacaaggaaacgtacactattctatcgcagggggcggttactagcggggagaatccggtcaggactttcgtggctaggagggcggccaaaaatcacggaaaggagggttccctcacccattacgtgggtaaattcaacccatcagaagaacctcggcgtattccacgtggtcgaccaaaacaacgacgagatccagttcgaagatggggaagtcctcgtggaaaccgaaccgatcggctacgaactgaagtccatcaagtaccaaagaacgaaaaagcgacagcgcaaaaataagcgtgttctcggcttcgccaccttgaagaacgaagagaacggtttgcagcgcgtagacagcgtcatcagtttcaattatacctattccctgcactggggaaaaggccacggaatgctgacaggattgccgttcaacgtgtcgctgccaaacgggactcagatccatggagcgtgggctatctggcaggaaacgaatgtagtggaagtggcgccgattgaaaaatacctagaagcaggaacagcagtcaacgttacactgatgggcaactacaccgaaatagaggttccttacacagccacagtagtcttattctacgccgacaacggaacaagagagataacaatccgagataccaaaatcgaaaataaaatgatggatattgtgactgtatacgacccggcatactttatccacaacaacactttggtccccaccacgacaactacgactaccacgactacgaccaccaccaccaaaactaccacgcaagaagtaattcctatcgctccaccccaggtcgtgatcaaagataggaaatcggatggctcatcttcgatcgaagggaaacacgaaaatggaagcatgctatcagaccaacagacctcgaaacatgacaacgcatcatctctgaagaagggcgatccccaaacgagagagagcgtggacgggggagcagcttctagatctgttatggggatggtgacgagtctcgtactagcagtcattgtgtgcagaattacgtaaacagactttttcacttgaaggaacagcctgcttgaagctagcggttgaagttaacggtcgtcaaggagcaagaagttagccccaatattcatgtttttgaataatcacaatgtttgtttcgttgcaaatccagacttattgctatgtcgtttctgtgtaatatacttgttctgttattattccatccacaaacaaaaaagtaataaaaatataaatatttttttcaaaatcatgttttccaaagtacagattaatatcgattggggctaacttcggagcaagtcctatggcagctttcgacaaaaatcattttcactatctactgttttatggttcttgttctgttgctatattcatcctatctctttcgactattgtttaatgatgtgtatataactgtgtaaataagcaaagattggtgaagaaaatgctagttgagaattggtgataaaactacgtccaatttgtaaaattcctattccatatgtatttcactatcaaattctttacaaaatcagagatttaataactttttcaatttttattacttctttagattcctagaaaggaatattgaacttggccaaagttcatgaattcattgcacaatttttgaaaggtttggtagcaaaattcatatagaactggaaaggttttcgtataattttagagtgtagttttggggtatggttgatttattaaagttacgtctctctaaatgatacttctgaactgattaaactcctttgaggcgtaatgtattcttgccgagtatggaacatagaatactaaaatcattactagcaaaatggaaatatattttgcaagacaaatggtagtaacgtagcgtgtggtatatatttttgctaaaaatgacggtgttatttttgttcaaaattagaatgtataaaataaactttcttggcgctagcccatcgacctgtctaaaataacgatcatgttcagtgtattgttcgaggtttagaaatgttctcatttttcgtttccaagtacaaaaaactaatattatgtaaatgtattttctgaattttgctttgttgttttctagaatatttcggtgtagtgtttttttaagaaactggcagtttggctctagattgtaactgaaagaactcacacaaaaacaaaattcagaaaattactatatgtaaaagctcgatgtaattactaaccaaaaaattgttctcagcattgtgtatatataataaaatgattattttaaaataatattcaaaactattataaggtattattcaggcccaatgcgaaatatgatatttcttcaagctttgcaatgtggctgtatctttctattcaatacattatttttgtccatttaaataaatatcccaatactgctgtgaaactttccaaaaactaaagctaagagtatatatatcaattttgatgtgttcaagaattaatcaaaactcagcgagttattcagcttataatagtgacaatatttgtaaggagaaaaatcatgattgctgttctttttgtgattgatattggactgaaaactgtcttctgtaaagattatttgtttttaatattattgtacattcctatgatatgtagatattcattat

SEQ ID NO: 115 - DNA, 2984 bp, Leptinotarsa decemlineata
  Annotation=Rap GTPase-activating protein; Tribolium gene name from OrthoDB database=TC006305; Blast E-value Tribolium Gene vs. Leptinotarsa Unigene=0
gttttattagatcttgacgcagcaaacaaattgtcagagacaaatcgaggtacataaaaacagttacataagttatacaaaagaacacttaatcattataaggtacttaaacgataataaagcatctttagaacaagaaagaaaaggggtgatgttagtcttctaaaaacatctagaaagtgttgaaaccacatcgattcagaaaatattcaaagttttgcaaatcactggaaggttttgtggtaattaatccattaatatttttaaaccaatcaatttgcaatgctattttgttgattcgtccccagacaacacaaggacattcaattcatgtccacataatatcttatgaacgtccaaaatatgtcaatctggacatctataagatatcgcacacttttttatatattatggatattgacaggatatccatcaaacaatattcataccaagtttaaaaaatctgtttaaaatctgtttttccgttaaccagctgtcgcacccctacgaacgacaaccctcagaagtcgaaactgggggatatcttatggatatctatttcatatccaaggatattcttaccagaattagacatgaattagatatctgtgagtttcacgactttgtctgggttgatttgatggggttttgtatctagaagtgaaggatcctagggatagacatagttttgaaaagtgagaaagtttatgtacacctacaagatacattcatactaaactttagtaatacatatttcagttgtacaaacttaaaaaatatttgaacaaagtaaaaataaagaatctataacaatatctgcacaaactaggttgttttttctaaatagaaaaaattaaaccctaataaatactttgttatatacacttagtaaataattaaattttctgaaacagaatttttggggaatgttaactttggtataattatgttggtaaagtttgtattcaataatatacagaatcattacacattaataaatatttaaaaactaaaaataaaatcctcaaagaaacatacatttataaaaatataaaaatatcacaaaacaaaaagaaatattcgagttgagaattatgtgatgtgaaactctttcaacgattaatgtggagcgtgcaaacatctatttgacatttttcacattgatctaaactatttcattatggttttgaaaacgaaatttaatcattacccaggaaagaattgaactgaaaaataattcttaaaatggaaactgaaaagcctaaaactttaaaactactacaaacataaagcttttagctagatattgtaaactagtttacattggagatctgtcaccattgggactgtaatctttcaacaattcgcgcaaccttgaaatttcctttgtcgcaactgctaaatcgccttggagacacaattccttttctcttagtcttttgatgtctcgttgacaactcacattctgcctcaacaaatccaacttgtcgcacttcaactgcaccacttcctgcatcagggtctctacactaggccccgctgtgcttcccggtctgtcctggcaaacactgcaagcttttgccgcagtctctgcgctagacatactctccagccctgtgtcgctgtcaatgtacccccctccaaggtgctctaggtcttcgctagtcaaggaagaatcgtcactggcttcagagagagctggcctggcgtttgcatgtgccgtcaggtcgggagaggaggtcatggaggagttgggacttccgctctttttgctgttggatatcaccgaactcttggatcttccactcgaaggagtagactccgaaatggtaggctgacttcccttcttggacagcctatcatgcccattggcattcaagttgttatcaacgctttggctggccttcaccctggcgctccagactttcttcacgctatcgatgaatctcgacccgggtccagaatcgctcttcggcgtacccggagccagattggcgttgcctcccaagaattcagtcgtcttctgcttgagttggtcggtgaggttctgtaagagagaggtacgagtgcgcagacccagtttggcgaacttgtcagctttgtagcaagcgttctccgcgttgataagcttcgttagcagaaactccttgaattcggctccgtgtctgaaaatggcgggagtgggcagagtaggtccgaagaagggaacgtcgtcgcgtgctgtcacactaaccttgtacctagtgttcggggtgtttggatcgatgacttgcaccgcgatgaaggtgtgcaagaagtgcgatgcaatcatgtccggtgtgaacgttgtgttttcctcttggaaaacaatcgccacaatgtcgttgccgatgtgcctcttcctctgcagttgttgtgggtcgttctccgtgtacggcaggagggtcgaaacgtggaacattatttcgcgttccttgaatacctcgtagacggccgtgtcgccggtgtggccgttctggatatcgaggccacctctgtatcctttgtgatccttgagctgtatcctctgccccagcagcgatagaaaatcgtcaaaagccggcgtagtgacgttattgcagaacaattcctcctcgtccatctgtccgaatcgctgatacaggacgccgaacttgaaatccttgaccagaacgtgttcgtcgtattcggtgatgagctgggaggcttggggatggaggacaggtacgaagtttttgacgttgagttgttcgttgaggatgcacgccatcttggcgggcgagggactgggatccaggcacgaggagggtacgatctcgtgcatggtgcctgtgcaaagccggagcaggatgcgggtgtgttcttggttggcgacgttctccgttttgatggagagcagcacgggacccagttgatcgtcttggccgatgagggtcgagtgttccttcttaacgaaaaacctcctgtaacatttcgccgtgtcgtct

SEQ ID NO: 116 - DNA, 3285 bp, Leptinotarsa decemlineata
  Annotation=COMPASS component SWD2; Tribolium gene name from OrthoDB database=TC014755; Blast E-value Tribolium Gene vs. Leptinotarsa Unigene=2E-164
actccatgtttcattgtttgtttgtgttgtgacactaggattctacgtttctacgcgagattatttcaaaagaacaggagataaaccagtggtgatgaagatgaaactggtagaccaggttgtacgaagttttagggtggccaaagtatttcgagaaaatactgacaaaataaacagcatcgatttttcgccgagtggcgatactttgatatcttgtagcgaggacgatcagatcgtgatttatgactgcgaaaaaggcacacagctccggacggtcaacagcaagaaatatggtgttgatttgatacattttacacatgccaaaaacactgccattcacagttccaccaaagtggacgataccattagatatttatccttgcatgacaataagtacatcaggtattttcctggacacaccaagaaagtggtttcactttgcttgtcccctgtcgaggacacctttttgtcaggctctttagacaaaacgcttcgcctgtgggacttgaggtctcctaactgtcaaggtttgatgcatctatctggaaggcctgtagcggcctacgaccctgaaggactcatttttgctgctggagttaattctgaaagcataaagttgtatgatcttcgatctttcgacaagggtccatttgtaaccttcaaactgacacaagagaaagaatgtgactggacaggcctgaagttctccagagacggaaaaacaatattaataagcactaatggctccatcatccggctgattgacgccttccacggaacacctctccagacgttcacaggccatctgaaacaataagggcatccccatcgaagcatctttcagcccggactctcagtttatcttcagtgggtccaccgatggaagagtacatgtgtggaacgctgatacaggttataaagtttgcgttttgaatgcagatcatccgggccctgtccagtgcgtccaattcaatccgaagctgatgatgttggcgtctgcctgcacgaacatggctttttggttgccagcaatggaagatacgtaggtgtctcgtttcatctctttggaacacatcaattttttctagtgagattaggtattaaaaatgaaaatttttatgttagtttcatctgtactctggcagtgcatatacaggagtgtggggagtgtatagagaggtaaagtgtaaagtaccagggtgactttccaagccaaatattgacgctttgcagtaaatgattatattctcagaaaaaaggaaaatctatctctcagtttcatcaattacctcttcatcggtgcttaatttcttcccagcaagtattctcttgagaaaagtcactggaagtcagatctggagaatacgatggatgcggaagcaatttgaagtccaattcatgacgttttgcaatcgtttttattgatttgtgacatggtgcaatttcttgatgaaactgcacttcctttttgtgaaatttgatatgcgtattgcatggtttctggatttgttctgaagaaataccattttgtcagatattttgatgttttcaatgatgtgaatatctcattttagacctactttttgggttctttgtgaagaaccgaaacatttgattttattccatttgatttaccaaatgttggcatactactattgactatgtgatatctgtagtgtcatctacagagaaataaagtttcagagcctggtcgctggagtggtctcagaacagaaccctgttgcattcctgatgtaacaagtcgattagagatccaggttggcatattggtatataattttccaatgacattttgccagtttcatttttagtgatctttaaagcttaccaatttgtagtaggattatgattggtatcttttatacactgaattttacagaatttttttaacaaaagtattttcagagtattttatattaaatttattctgtgtagaaataaaatcatgaaaactgtatcaagaagagatacatacttaaaagaaaataacatttccgcatttttttgtataaagaatgagaagcaggaagacaaatcattttttccccgagaaaatgaatatttcgaaatacaatttccaaacattcatctctctctacatacctagacagtaggttctggtatccactatccaacgtggtattagccggggtagtagttgttttccggcaggcatttaccagaacctattgtgtagatatgttgtgatgtttcttcacagccaagggctttgtttacgagatggggctttcattagttaatcgttacctgtcctgcatcgatgaggggtaatgcttcggaaaccggtctgtaattgatctacttgaatgatttattttctaaaaaaactaatcaatacagtttattgtatgattttcactataaagggttttacaaaaaccttgacacgtgttttgctatacaatagctttgtcaagcgtaaacatttattttcattgattctttgttttgtcatgtttgtgaataatctttgtgtataaattattctgaagaaaaaacaaagaaagtggtagtagatcggtcgtaaccatttctgttcaaattgttcagtatatttgagcagagctgattctttgggatctctaaaatcgtaaaccatagtctaatgagtagtggtaaagctggaatctgattattactacttaaactgaaattgaaagacatatgggaaaactcagaatttggatttgattgatttctttatccaaaaaaatattgtttggcctttgtcacaactgttgtactttttgtgttaacctgattatttcgaaactttccatgtaaatgtaatctatacattttttgtgcatgtcatatttggcttgaaaaatcagtattgacaatatccaggattgatgcgcttcaatgtggatttttagtcaaccaccttatcagttttataattatgtatttagcgctaattatcttgtgaatttcgaaaactacaacgtcatttaatgtacataccatctcaactctatatcgcatggattgatatagaacttttttacttttcaatgattgtaggtctatgaattgcattaaattatttttataacggttttgtatttttcttttaggttgcaatttagatttcttaggtgtaagccccttaaacaacatttcagaatgtctctttgctgttttcgatcttccgtaatttctttgttgggccagtttttataataaattactttcaattgtatttgttttttaatcaccaatttttctttgaatgttact

SEQ ID NO: 117 - DNA, 2720 bp, Leptinotarsa decemlineata
  Annotation=APAF1-interacting protein; Tribolium gene name from OrthoDB database=TC003137; Blast E-value Tribolium Gene vs. Leptinotarsa Unigene=2E-18
atatatgataatgttcatttcttaaaaagtctttaaatgctattttaactattgaaaagtttgttttttgaagtcgaaatgtctcttttatttttagaagaagacccatggttactggaatatgagtcttgtgagaaattgcatagagatgtaatggaacagctgagcttgagacaaaaacatccaagaaccagcgaaaagtacaatcaattatctgctaatattaggttacggttaaaacaatttaacaatgaagttggccaactcaatcagaaactagaaagtacaagcaaattgggtagtataacacctgcagaatgtgaaaggagaactagacaggtagaagttcttcagtcgaaaggacttcaaatgcaaaagatatttgatgaacaggtagtgaataaactgaatgaagatagaagatcacttgtaggggagtctagcatggaaagagtccctcttccaagtacttctgtggatgacttacgaacgaaccaaaagaagatgctcggagaacaagataggagcttggagggcttatcaagaatcatatccaggcaaaaggatattgccaacacaatttctgatgaggtcgatttccagaatgatattctggacgatctaggaacacaactgagtaggacagatgatagattgaatactgaaactcggcacatcgaggtagttgatagaaaagataaaacttgtatatactgggtgataatcatattgttatttattagtatagttgttgtggctgtactttaatttacaaacttctgttgattgatatgtatatacatcgtgatataacaaagaatttgaatatatttgatatactaattgtaaatcacagttatgtttcatttgacacaaagaagtatgtacgagggtggtctgaaaagtttctgacctcaacatgaagacagcagcatttgtaaataaaagctagagaactccgttgttcacctgttgacagttactcaccaaagtttcagccatttcggacacgcaatttttatgtaacagctttgaatgagttgatgtgagtgtttttacggaaatggacaaaattaagtatcgacttgtttctaaaaggcaatacgtttatgcaaatcaaagatgagttggattctattcatgagcatactatgtatcattagttgacaagctgagaacagaacttgcggaaaaacgtccctatttgaagaaaaaagaaaatcctgtttcaccaagaaaaccatttgaaattgcactaggacagagaatttcatcaaatgaagaggcaatcacttttgtgaacaattattttgcagagaaagacgccgagaactattctacaaagatgggagcatcgctggaagaagtgtgtagggttaaaaggagactgtgttgaaaaaaaatgccttgtatctttgttaggccgaaaacttttcagacgaccctcgtatattacaaactactgcgataattaattttcaccaatgacccccaataaaataaggataaaactcatgacatatgtactagttacttatgtaattggtgtcttcaaactgcacagtcattctaaatgatattgttgacaacttctcattttccactttgaaatttcaactcgtactcgtctggtgtgaggctgggatccagcccaagctgtttcatttgcacaacaacatcaaataaataatcgtagcactccgtcatagtttttgcatgctgccacgtatctccccatacataaaccccatgtcttcgaacaagaacggcgcaagtgtgtggatatttctggatagtctctgccaacatatctttcaagtcttcttcgaatggagtgttttctattatgggaaccactaatttttcatcgtacctaaagtttactccagttgcttgattcctaatgcctttgatcatttccaaatgggtacatacaaactctttaccaggaaatagtaaagtcgccagaacagctgcttttgaatgagtgtgaatgacagcacctgcattcctcattgtgtaagcgcacataaataacggggtacattggctttttttcagttttttctcaacaggaggcagttctaagtcaacaccatctatcgtttgaacaaacatgtcattgggctgtattctctctttttgcacagctgaaggtgcaatgtaaatttttgaatcatattttatgcttataccaccaccagttccagtgacccatcctaagtgatagaactgcctacataattctggtattaaatttctgggatgttcctcagaatattttgtatcccgataagacatgttcactttgataaagcactgcaagttcaaattagttgtggccaattcctaattgataacccctgttatctacattccatttccatcaacagtaacaaatatttgataagcaactatttttttttaagacaaatataaaggatttttgagttgtcatcaaacatatggtctttatctttatgaaaattagggctaacttttatatataggtaatatagccttcgtttcaattttggaataatcttagtttttaaaactagcagtgttgctaacaggatgaactataaagtcgctaggtacatatgaagcaaaattccgctacactgcttcatatttcgtctgtggtaacatttcaagataaatcaaggaccgttgccaacctctcgacgcgaacggcttcgctatgtcagtttatctgc

SEQ ID NO: 118 - DNA, 3118 bp, Leptinotarsa decemlineata
  Annotation=Periodic tryptophan protein 2-like protein; Tribolium gene name from OrthoDB database=TC010709; Blast E- value Tribolium Gene vs. Leptinotarsa Unigene=0
gaataacagttgacaatgattctgagttgggcatgtgagttttgaattgtagaaagtttttggtacttgaaatataatatagaatagtaactagatttgggtgacaaaatgaagtttcagtataagtttcaaaatattctaggaacagtttataaaaaaggaaatttactgttttcctctgatggcaactccgttataagtcctgtaggcaacagaataactatatacgacttgaaaaataacaaatcaaccactttacctattgaaagtagatacaactatgcggccttagatttgagccctaatggatgtacactcgtggcaataaatgaggaaggtgaagctcatatgataagtctaatttcccaaactatcatccacaagtaccgattcaagggaaaggtgagagctgttaaattcagtcccgatggaaaacattttgctgtatgcaaagacaaaaatgcatttgtattcaaagctccaggtccatttactggtgaatataatggtttcattatggaaagagtatttcatggggcatacgatgataccactttccttgattggtcatttgattccagaattttggctgttgggtctaaagacatgtctgcaaaactgtatcctctagacaaatgggccaactttagaatatattcattaggtaatcacacagatggaatagtgggttgttttttcgaaaaagatagctatgacattaccacaatcagtagaaacggtcaaacttgtatttgggaatgtactgttgatcctcaggatatgattcctcatgacctggctcctcctaaaaaaaaagaagaaattatctgatgaattagatgaagatgatgttgatacttctaaatctctggaacgaacggaagaagagattaccaaagccttaggagaagttgccgttaatgatgaggaatctaaagaagaaggggcgaagaagcttttttataagagaattgctaaacattatttggcggacgaagttaggaagagcaacagagaagcagttttaacttctgctgcctatcacaaaaatactcgaattctagtcacaggttattctacaggggattttttcatacatgagttaccggacatgaacgccatacattccctcagtatttctgagcagaagatctcttcgatagctttgaaccaaactggagattggatagcgataggttgtagtggaataggacagcttcttgtttgggaatatcaaagtgaaacgtacgtaatgaaacaacaagggcatgccaacaacatgtcctgtgtgtcttattcgaaaggatggacagctgattgccacaggtggtgaggatgggaaagttaagttatggaacttgagttctggattctgtttcgtaacattcacagaacacagcaatgctatcacttctatagcgtttagtggaaataagaagtttgttgtgtcgtcttctctggacagcactgttagagcttatgatattttaaggtatcgtaacttcagagtattcacttccaccagaccagttcagttctcttgtgtcgcagtcgatagtagtggagaatttgtagctgctggtggtcaggatatttttgaaatatatttgtggtcaatgaaaactgggaagcttcttgaaatacttgctggacatgaaggaccagtgtctggtttagccttttctccatcagtgactagcacaactatggtgtcagtctcttgggataaaacattgaaaatttgggatgctatcgagaaagggctctgctcacgaaacgattatacttaccgccgatggaatcaacgtaactttcaagccagatggtcaagaaatagcagtcgccaccttggatggtcaaataacatgttatgaagtaaaaacttctcttcaaacttcatcgatcgaagggagaaatgatttgggaagtggcagatcagacgccgatttaataactgccaagaagtctctgcaagccaaatgtttcactagcctgtgctactcagctgatggagagagtttgttggcgggaggtcagtcgaaaaatgtctgcatttacaacgttaaagaatcgctattggtgaagaaattcgaaataacacaaaacaggtcgttcgatgcggtggatgatttcataaacaggaggaaactaaccgaattcgacaatattgcccttgtagaagagagagaggaaagggaaggtggaaacattagcattaagttaccgggtgtcaggaagggggatatgaccggtcgaactctgaatccggagataagagtattctccctgcaattttctcctacaggagaaagttgggcagcagccacaacggaaggtctgttggtttactcgctgcatcattcttatgtgttcgatccttgggatttgcagattggagttacgccggctagcatcaggcaagctatcaaagacgatgaccactcaaacgctctcatgatggccatgaacttgaatgaggctaagttaatccaggaagtagtggaaagtactccagttaaagatattgaattgatagtttccactttggaatataaatatatccaaaggttattaatgacgatagcaacatttttggaaagttcccgacatttggaattttacctgtgctggacacaacatattctgactctgcacggaccgaaaatccaagcccaaaaacacatgccgactttgttagccctagaaaagagtctggtgaggaaatacgaacaactgtcaaaactctgcaattataatacatatacaatgaattatgtaattggattaggagaggtagcaattaagaaggaactgaaaatggaacaggacattgaggaagaagacgtcgaggaagaggtagaagaacttcaaatggattttgcaagtgatgttgatgaatatgaatgagtctattgaacgcagaggtgaatgattccatctattagaagaaaagacgtatggctgaaacaggtttcagattagtatgtaccaagaaagttcttgaatgctgtcaaaaacaacacttaatagatggaactcccgaatttatcttgttcctgtgaatgtacatatcttgaatttgtaaatagttttttatcttatatataatttcatattt

SEQ ID NO: 119 - DNA, 1457 bp, Leptinotarsa decemlineata
  Annotation=Electron transfer flavoprotein subunit beta; Tribolium gene name from OrthoDB database=TC008707; Blast E- value Tribolium Gene vs. Leptinotarsa Unigene=2E-157
gattgaccattgaccttattcacagggtatcaaagtccaggtccttttacttcaaaaatattcaaatttttttatatttcaattgattcaaaattgttagaagtgaataatggctcgtgttctagtgggtgtcaagagagttatagactatgccgtgaaaatccgcgtgaaaccagacaaaacaggcgttgtaacggatggagtaaaacattccatgaaccccttcgacgaaatagctgttgaggaagccgttcgtctcaaagaaaaaaaaattgcctcagaaataattgctgtgtcttgcggccccgcacagtcccaggaagtcatacgaaccgctctagcgatgggagtcgataagggaattcacgtagaagtatcaggacctgactacgagaccctgcagccgattcacgtctcgaaaatcctggcgaaaatagcccaaaatgaaaaggctgatatcataattgttgggaaacaggctattgatgacgactcaaatcagacggcacaaatgacagctgccatgctggactggtctcaagctaccaatgcctcaaagattgagaaaggtgacaaacatttgacggttacaagagaaatcgatggaggtttagaaacaatcaagtgtaaacttcctacagttatcagtgctgacttgagactcaacgaaccacgttatgccactttaccaaatattatgaaagccaagaaaaaacctatacagaaaacaaccccgaaggatctaggtgtagatatcagtcctcgaatacaaatattgagtgtagaagaacctcctactcgacaagctggagctattctaccggacgttgatgctcttgtcggtaaattgaaggaaggaggtcatatttgaatttgtcaccgttttcaggaaggtacccgataaccacatgtgtctgaatcatatcaaattgtgctacattggatggtttttgtaaagtccgacttttaactcatcacatcacgtggtgttctttccaaatttactgttgatgaattttagctggggatattcagtttgatcgagtttggccttgaatgctcactacggtattcagaagtgggataataacttgtaaaaataggtaaggctttttacattcagttaacggaaaatatggtagaaatatttgatttcctgaaaaatctaatgtttgaagctttatatttggcagaaatttgaactttgatagaaatatttctttcaagcacctcttaactttccttctattggagttttattgtattcagtttacagttggataagacatgcgttggttgccagtttagtaattttttagtttttatcaaattcatcatatccagttttatataatattcgaatgtttttattgtgagtgcaacttaatattgttgaaccatgttgtttttttatagttgaattttaatgtacctaaataaatatatttataataggg

SEQ ID NO: 120 - DNA, 5107 bp, Leptinotarsa decemlineata
  Annotation=Transcription factor; Tribolium gene name from OrthoDB database=TC030734; Blast E-value Tribolium Gene vs. Leptinotarsa Unigene=0
atgtcttagttaaacgtctattggttatgtttacatgttttttttcgaaatatttggaggtacattttttaaaaacattggaaatttgtatttgggttgattttcatcgctcaataaaatccccttctaattttgtattcccttatgtactggaatcatctgaaaagatgtcttctcttcctgaagacggtagaccaaagctgaaagcaaaacgattcaacaaattccactcatcagtggaaacttcattaaccgatacttcaagtcatactggtcaagaccgacaaggattgaaaagaaaaaatgaggagtcatttcagataccatcacaacctaaaaagaaatatgaacaatcagctatcaagcccccaattacacaaaatttggcaaataagaggttacaaaacttgaaacgatatttaaagagtgatgtgaaacatggaaattccagaattgaagatagatcacaggaagagaaaaaccaacacagttcatttcagaggagagatattaattctgtgagtgtttctcaagatacttcctgcaatatttataaaaatctcagtcagtgggcaagccctccactggagagaaacatgtctcttcatgaatatgacaaagggatcaattccaacaatgcagaacagagtagatctgctcaaggaaagcaagagtatggcagtttcactaaccaagttagacaacttatccattcagactgtaccaatccacaaagcctacctaataatgatacaaaatatggaagtgaacctcaaaaaatgtacactgtacatcatacccaagaagatagaagtattgttctttcgaaacatagcaactcgactagtcctgttatgaactttaaagatttcagggaatctaagagatgtgaacaaaccatcaatgatgaaaaagagcaagctgttactgaaggtaggagtagcagtatttataaaaatcttggcaagtgggcaacccctccaaatactatacctcaaaaaaacttagctggtagtaggttacaaaaacttaaaagtgttcttaaagatgcgaaacctgtagttggagacaaatcaactaattgttcaactgcaaactcccccactgttgaaaattctgaagaaaaatatcgatctcctttacttagagaaaaataccgatctcctttgttcaaggacacaggtatttctaacaaaagacacataactgatgatttcgtttccgaatgtagtcctgcaaaaaaaaattgttgtcaatccttcattttcaagtcttagtagatcttattcaaaaaatcatttgaatgaaataagagatagaagcacatcatctgaaaatttgaataaagatgctgtaaatgtttctcagcgaacagttagagacaatgtatctttaaatgaatctaattgttccacatcgtttcaaaatatcaattcaacagtggtactgaatgactttcatagggaaaataatgaaatacacaattctccttcaacacctatttcaaagagattgaattttattagaaacaaaccagacaaaagttacaacttgtcaacaaatgcaaaaccttctgtttctaatttcaatacaccttccaaactatctcagccccaaaaagaaaatccaacagaatgcctggtcctatctactgagaatacagataatttcagtgaaaagatggctatgactgctttctgggtaagcaatcttaataatgaaaacctaacacaatctccgtgcaaacaaggtataaacgtagtagaagaagttaacaataaaattcaagaaactccagaggataattccatggagatggaatggacaaatgctgaaccagataatgagatagtacaaaataatcataacgaagaagagacagatagtaatactgttgaacaaccagaaactaaaaatcagccaagtaaatcaaatgatttatgtattgtggtagatacgaatatttttatacatggactatcgaaaatcaaggacatcatcaacatgaaaatttcagggccaattcaactggtattatatattccttggatggttataacagaactggattacatgaagcatgattgctcactagacagtcttaaaagaaaagtaaccaattcagtaaaattcatcaattcacatctggaggaacaaaatccaagattagttggtcaaacggtatatgaaatggaaaaacaaaaatttattggtaaaagtcctgatgataaaataatctcttgctgtttacaagctgcagaaaaatatgaaactgtgatattactttcaaatgatctgaatttgaaaagtaaagccatgataaaccacctaactgcatgttcagaacacgatataataatgaagattttatccattaccaagaatactaaggcccagaggataatgcaaaaaaatgagtatattgtgctcttctgtgatttgtgaatttgccaaagaaacttatggagaggtatggtcgaaaatgagtatgttgtccaatccaccatggtcgttagcggaatgtttgaagcgcttcaagaaatattgggggacaatattcaaagataaactcttaaaacagtttacaaaaaccatagatgatttactgcagctcttcaatgaaaataaatattttcctgacgattcagaagattacatccgttttgtcaaattatgcattaatatgtgtatattcctgaaggatattgaagaaatcagaggatcagtagagaatgtattaacagatattaaaaaatttggatgaatattcatttgttttttacctaatcgtgttttttgttattctgttataaattatatttttgtatgaaatagtgtatataaaaaaataataaattcagttcctaatgtttgacttggatatataaagatttttatttcctgttacataatctaaacaagttaacaaggtagtgtgaatgtcatcgttaatactgatgacacaaaattcacgtcaaatcatcgtcgtccacagaatcatcgtttccttctgcgtctgcatcattaggtacttcaggcctaatattatttaataaatctcgcatagcatctactaaagacgcaacactacttcttaaatcgcctccctcattgttttctccatcttcaggtaaggctctagcaccctcttcttctctatcgacttctaataaatttgcattaaaagatggtaggatagatctaaaaaatattcctaaagggttcgcgttactatttgctagcacaggccttcttgttctcgtataaagattgatagaatctttggggggtaaggggtcgaaactcataacaggtccactgttttcatcagtcaggggagatacaccttttaaatcggacagtaatatatggcgagatacattttgtggaaggggtcccgaaaaccttttcattctttttgtttcacattccttaacaattacatcatttttttctaccctatctagaacttcgtgcacatttttctccaaccaaggtaaaagatcactgtctttccatatatggtaacttctgtttatatataacagaatcagctggttgagagccggcggttgcctcttttgatcatctgccgtaacaaagtaagtatgattagcaactctattgtccatttgcactgtacacttctcaagaagaggtaatagtactccagggaacataagcaaagcatcctgcagcaaaagatctgcttttgcactatcacctaagtaaaaataagtaacggctagagaataagcaaaattaggtaactgtaaaagatttttagtactgtcccactctgcaacgaaatcaataaaccattgatactctcttgagcgaagagcataaaaatcgatggcaagtatcactcctagaggatctccatctgggtcaagagccaagagtaatttgcaaaattccaacgatgttcgataacacgccttcccaccaaggaatagtaaatgcttgaacatcgttatgtacaaggccctattttcttgtctcctgtagtctagtctgcagttgccttgtgctacattgaacagtggatgataagcatattccaagatatacaaggcacgctctatcaagtcagccgccattgctaaatcttcgctcaacttacataaatcggaaagctgaatcaatgcatctacatggcactgatggtcatttatgatggcaacaatgttatctggattcaagctttcaactgcatctaaaaatttattctgtacttgtctgtagctctggctgtgttcgtagctgaaatactggattccatttttgttttcgatatagttcatagacagacccgacttcccagcatttgggtaactgtctctacagtttaccattgttatcggtttggcgtgacctctaccgccagatctgtttttacgtttgtggtcagttggaattactttagatccaaatattctcttcagctcgttgtttgggttgaggtgcttatgttgaacagataaagtgtttttacgataacttgttttatcctgtttcacatttgtgtgggaggtaactttaggtacataattctcgcctagcagcctattcacttctcgcactgatctctcaacttcatcaatatcagcattgtcttcactgcttcgttgagtactgacatgtttgccagattttttcttctttttcttcttttttctcttgatctcatgaggttctccttcacaagacttagcagcctctgtttcattatcgtcttccttcacttcactttctgaatgagactgttgattcaactgaaaaacaaaatatcaacataagttaacatagttatatgactaaatcaaatataccaaatcataacgattgatattcagttgcttttttcgagcacctcctgtaacaggagtatctgtctcagtatctgacacctcctcagcaaattctttttctttgtctccttgaagttttcttaacactctagatgacatatcgatgcaaagttcggaactaaacaatacaattcaattactcaatttacgattacaaataatcggcattagtacttaaaaaatatttaaatgacatattatgagttttgacgttttagttcagattgaaaagc

SEQ ID NO: 121 - DNA, 3999 bp, Leptinotarsa decemlineata
  Annotation=Coiled-coil domain-containing protein,; Tribolium gene name from OrthoDB database=TC015324; Blast E-value Tribolium Gene vs. Leptinotarsa Unigene=2E-4; Blast E-value Tribolium Gene vs. Leptinotarsa Unigene=0
aacttatagatcaaatcttctcagagtaaaactaaatttcaccacaaatttacaatagaaatgaatctaacaaatacataggcacatcagaaaaaaataaatatttcaaaaaatatactataagaatataagaagggtcacttttaatataatacaaaacatttggataaaaatacgttttaatgttaatgcttgtgaatatttacttaacatataatttgattttttcaattgtataaaaatatattaaaaacatgagcaattattttatatataaagaaggaaggttaagtctaataaggaaacaagtatatactactactacagcaggaagattaaaggcagttttgaaatcttgggtaatacaaaaactaaaatgttcaacttctgataatattattccactttgtatcggactatgttgattgatcattgcatcagaggcagtttgaacgattgatttcaaaaagttttttttcattaaattcaataggttaaattaacacttctggcgcgaatcaatctattgaaaacacttttctcaaatcagaacgaaagtttatcttgaaagataagttatcaaggaaataactgaaatggttttccatactcgataagttgattagtaaacgaatatttggagtaatttatagttcttctacataaaacaaaatggactaatggattggttcgaaatttcgaaaaagcaaacatgaaagtggttttcaaaactacctatacatttcagcaagtgtttggcaacccaaaaggcagtttagacaaaaaaagtctgagattcaccaaataagctctgaagtttggagtttaggatgatacgaatgttggtcaaacttaacgggatataaaaactcgatatatggaacatttttcagctattcggctacagaattagtttacatgtccaggacttttttttgaagttcataaatgaaaataactcaaatgaggttcataaatagtgacaaaggccaattattcactctcttacataataattgcagatagaaaacatgaaaataataggtattataccaggctgtcaataatatatgaattaggaaataaaatttaataaggaagtaacacttaataacctccattatgtaagatgatggttcttccatatgtacatacaaactctgatcaattatagactattcctgatgatgctaacttggtgtggaacttttgttctggtgtggaataaatattttcaatagctttgattcaacacgtaggtgtgattaattcctccgttatgattctacaatggaatctgttccttagagagactagtccgaaaaaaaaatattattcaaattttctattggagaatcttacgattaacaaccttagtttgaattatttttctttaaatcttgtctcaatttcatattcatcatcagtatacctttataactaatgtgggtttctgagatttgtattattagatattttttttaattaaaaataattaaattaaaaatcatatgattcgttttcacgtactttcaccacaataagtaatttttttaatattaattgtaagtagtctatatttatttataatattcaatttgattttttatcaaataagatcattttgaaataatgatttcgattgaaattttttcattgtcagtttttttttgtcactagctcttgggttaatatttccatcaagtcgttcaatataaatattatcgtaactaattgtaaactcacattctccagtagtgaaattgaaaaaatactaccaccattctattttttcagaggtcaagtacgaaaataaatcttctatcacatagttcaatgttttcaaccactatttcttctaagaatggcatggatgttcatgcttagtctgagacacataatatagatcatttcaacaattccaaatatatccaatttatacttcgtacgttagagtatctgtattctgaaaatatttttctacgtacctctttctagaaaaatatcacaaaattattaaagaacctaaaaccgcatcattcaatccattggacaagatatctatatataacaactatcatctaatatgggtggacacttgctataccgaccctaccattattacctacagaactgttagttctatgcagcatttcggaaaagttttttttcccactcttctccatcctcatcttgggctctgcgtaactgtgcctataaccagctgagttcttaacaaccttctggttcttcacgaacttttgatcgtgcttaatttcgcttattttatctggttctatgctcggcttggaataattatctaaaaatctatcggattcgggcatatcttgatagtatctgtctctgttgaatctgtccatatcctcctcgtaggtgttgccgtccatataggatcttcgttttagttctttagcaatttcattcgagttttttcggtgctcctcttctatcagtgaaaacattgacctcctcttcggatcgaacttatcggtatgacggtatctatcgagaggctcgtctctttctcgctctctcatgccgcgctcgccatttctctctctgtaacggtgttcctcagggaggtgtctcggggccggtttcggtcgcacttcttccaaatgtcctctccgatcgtcataataacgttcatcataactgtttctagaagtttcttttccgtatcccccattttcgtatttctttccataaggttgtttctccttcagctgcaccggagatatgggaggttcaggcccccttctctcattctccaaccgttctctttccatcagcagaaacttttccttggcgtctttgaaacgatctctcggagccttaacttcatccgaagctggcgacgattgtcgatattgagcgtttcttctgttcagagtattctcctcgaagtattcttgggacctcgcagacctctcttccctttcgcttttactacggagtttgccagaattttctttgtgtgatgtcggtcttggaattgatttgggatctattactggttcggtgtagtatcgaggatcgtctggattgcatctagttggactcttcgggcccctgtcgctacttctagaactgtcttgataatatttgattgcttcttcgggaacgtaccgttgcctaaccttcggtaccgggaattctttgaactggcgatgcttgtcgtcgaaaaatacatcttcatcgtaggagaagtgctggggctgttctctatcgaaatctgttgatttacttcgataccttatattttcatcaaatccgtcgtcttcgaaatatttcacaggcttatccctatcacctttcctgccagaatatccatccctgtctctcctggaatcatcaggatatctctcgtcatcatagtacttattatcgtcgcccacgctgccttggtaataatacttattgccatggaacttttccttcttctctagagtgttcgaatatctttctctttctaattcgtcgtaacttccgtgtctatcgtagctcttcagctgcttccccttttctaagcttttctgtctctccagatattttttatcagagaatttcgctattggtttttctaaatatttatgtgtttcatctctgatgtttttgcctggcctgtaattgtgttcttcgtattttgaagaggggggatcagcgtacctggagaacctctggactggatctggagatttttccctactggaacgttcaatatctacttgcgccggttggtgcataagatagatagtggattctgctgggtctccattccaatcctcatcactagtactctgattgtcaagagtattgaatctggaatcaggagcgtctggagaatcgggactcggtggatgatctgagccaattccagagctacctccgctactttctatccgcctgcccttcacattttgtccaacgatattggcattcaggcatctcctcaattcgatccccgtcagatttccc

SEQ ID NO: 122 - DNA, 1352 bp, Leptinotarsa decemlineata
  Annotation=Polyadenylate-binding protein 2; Tribolium gene name from OrthoDB database=TC009984; Blast E-value Tribolium Gene vs. Leptinotarsa Unigene=4E-127
ttttttttttttttttttttttttttacttattttttgtcccaatttttaattcataatttttacatcacattacttcttttacattttttccaatattacttaatcttctgaaaaaacatactaccttggtaggccgaaggtacctgcaatctttatgttaaatatcgaatcatgtaatagcactcacccaaaacacattctctcaaaaactaaagattcatatttgaatttctctcatacgtcaaacaaaacataaaataagcactagtttgtacttaatgataattttcgtgaaactcgtctttttttttcagtgtcttcgccttttttttcatatccttgcttttttttctttttttctcacactgaatgagtgactcgataaacaataaagggatgtgtaaaaaaatgtaatgtgttccttacttttcaaatgcatcaatatggtgcataatatcctcctcgtcttggccggcgcattggtctatatccagaataaaatcctctacccattcctcttgatccacggaagattcctcgacctcttggaggcctgtttgttgttgataatcctggacgattcgtcctttttggcataacctttatctgtcttcctctaaaaagtgattcatccattgccatggcagtttgcacagaatctctatctgcgaattcgatataggcaaaaccttttggatgtccgtcatatttattgcaaagaatagtcacacgattgattgagccacaaccatggaaatgttgttccagctcttctgcagtagcaccgtaatctacatttccaatgtatacactacgattatctacttccattttttcttcgagagacatattgagaggacttgtcaaaccagggggactgcccatgttcatttgtttatcaacttcactctgtaactgtttcaatttttctgcttcctcctccatttcacgaaccctggctttgattgcttccaattctggatcatctccagcagttccgtctccatcagtatcattcaataaagagtcgtcgtgcataccattagtctcatcgaaggaatctaagtgatcctcacctaaacccaagtcttcgttatcggccataactgaactgtatttatttaatttttttcactagtggtagatatatttttttcatataaacaggttaccggttatttatttcacgcaattaccgtccgtgtctacaagaaatgaccacttaacagaaatggcgcaaagtaaacgcgtacataaaatatatgtagaactgaataactggatacatgtatgaagaaactaaatggtgaacgaatcacgtatcacgtatcataaaatatcgtatcaatc

SEQ ID NO: 123 - DNA, 4384 bp, Leptinotarsa decemlineata
  Annotation=TATA element modulatory factor; Tribolium gene name from OrthoDB database=TC003130; Blast E-value Tribolium Gene vs. Leptinotarsa Unigene=0
acaggattaaaaacgtatttactcatttataccataaattatgagatatgatgaactctttacaagtgattagttgaaaataaatgagtacttggaattgaaacacgttttcttacttgatctgggttgagtcctcagtatgttattgatgaaactaagttcaaatataaaatgtatgtgagaaaagaaagatataaagtaaatataacatttcaataaaaaatgcaatatctaaaattcttgatactaaatattttgtatgtctataatagccataataatagctataatagccaataaacaagttactattttctgtatcaagatagagtagtactaagccaaaaaatttctttcccaacaatctattccatttccagaaaattcaatttgacatgtgttgaaggaaaaaggctgtttccaatagaggcggtattcaaaatctaatttgtgaagtttccgaaaggagaaccatctcaacttttataacgaaatcatcactttgtgttttgtttctgctgtctcaatagctcatctatttgtcccttgtacatttccttaacatcttgcaagtccaatttcaattcttcattttcttccaccttctcgccaaataactgacagagtgtatcatactgtcgttctaattcttgcaatctagtcttcagactatcataatcttcagctctaccagctaattcttcaactcgggtcagcaaagttgatatttctgtgtttaggagggatcgctcttgctctctcctgttgagctcccattgtaattgctgcaattctccctcacgttgtttcaaatttgactgcagcatttgcatttcaaacatgttggtatatcgaggggtggctcctgtatcaaaaggttcgtcctgagaccagaatgaaccagccattgattcagaaacagaaagtttccctaagctcagagtcggtgaattgcttcctgttagtgaagtttgttcaaccccagaggactgtatatcaccatttattctattttggatttgtaatgattcagcctgccttttatccatttcattggttgatttttctaaagttaactggtgctggagggttaaaagctgacgttcctgctcatcaatgacttctttatttttcctaataatatcgttcaaatgatcaattttgttattcagttcttgttttgtaagtaaattctcggttttctgtctctccaattccatttccaatctttcaattttgtgttttgaactgttctctcgactgtcaatttcagataatctagaccttaatcgaatacattcctctttaacttctttttctgaactgatagatgtttgtagtttggcctgaagctcatttaatttcattgttaactcttcctccattttctcaaagccgctaattttcatggtatgtgttgcttgaagagactccaattgacgaattaaaggtttgctaacttctaaaacagactgtgatagttcttcattgcgggcctctgcctcttctaatcttctcagcaatttatttttttcttcacgatgccattcttccttcttaatactaacttcttccgactgccgcagtttgtgcctcagatcttctagctgatttatgatttcttcattttgtgcttcagcgagtttcttctggttttccaatgtttctaccatttgttctctaatcaacaattcactgtttgacttatttttttcagcaatgtccttcttagcagcctcaagggacctttttgttgtatcatgtttttgtgttaagtcttcaatttgacctttcaactgtaataattccccgtccaactttttattccttgttgttaactgatggacagcctctatttgagtgcgttcaacttcttccttagctgcaagtgattttttcaggcggtctgactctgatgacaacaattcaattctttcccttaaatgttttatagtattttcattttctttttctttcgttctcaacttttttatgatatttgaatgctgcaattgttgtttggaaagcttctctccttcttctctgagctcccttataacctcatctttttcagatataacagcatttatctcgccattactcattctagatgcggcctcttgcttgatttgttctaaatcttttctcagactatctttctccctaagagtttgttgaaatttttttctccaaagctgacagacgctgagtatattcctccgttacttgagaaacatcggcactttctaattgccttgttataatagaatccatctgaatttgaagatcgctattcatttcttgtaattcggcatttctgtgattcaaatcaataagtttggcttctctagactcgagaatctccgtcatttctgagatcttcttcaaaagcctatctgtctcactatgaaaatcgtcgctgatactagaggcctcagataattccctggtgtgtcctttcgttttctttatggtcattttacaaagcagggaatctattgtggagttttccgacttagtttttacacatgttggtttggcaggactttggcgactctgtgtactgctggaatcaccattagggctagaaattatctctatatcagatgaagtagtggtttccagttcatcaccagatgtgtggtctgagcctatcttgaccaaatctgatcgactaccagaactgacaggtgagttttctctgggtaatatttctacttgggaaatggaaatattttctaaactgttcttatcagaatcttgagaactaatacaaaactgctcgactttattattttgttcctgatctgaaaaacttttctcaagcatagcatcagcaagcataatttttaaataagtggaatgactacttgcttcagtagcggtacttgtatcactgctactttccattatactatcactgcctataactgttttatcagaatgagagctttcatctgtagaaaaatctagcctacattctgttgccatttcactttctgaaggaatatctataacatttgttttcgggaggatatttggcatatcttgtttattactttgaggctgggtatcaatcataacctgggagacttgagtcaaaggtaaatgcatcgtgcgactaggagctctagtaatggcatcactaataaaggaagtatttgtagaattttcattctcgtttaaagaatctgctcgcataaaagtatctttaagcattttgtgggatttcagttgggagttgaaagtagaatccagaactgtggcagaagtactttcagataatgatgtatacgacactgtatcttcggctatactattttcttcttgatcttcaggaataacttctacgctgtccggagaagttttttcagaaacgctggacttttcttcagaccaaggagaaagcaaaggagaaacaaattcatcagtaagctgggattggcgtctgctacttgtactgctgcttccaattacttcaacagaactgggactagttagactatctccaattatttcaacagaatctgatccaggttgtgatcctaaagcagaactagaagtagatattgactgtcccagtgacagcaaatctgaatccgggcttgtacattctgtactacaagttaggatatcaacactctctgaactgttctttccactttcgccacttatcccagagagtctgttgatttgggaggttgttagcttatcagatcttctaactattaaggtatcattttggttatcaccagcttcattttttccatcacttaaacttatttccactaaatcagacaggtcatctgaggagttttttccagctactttttctgattcatcatctccatcttcacttctctgcaccactagtttactacgactgaaatgttcatcgctgcagtcaatggtatcatctagactagtattagatgctgatttgactatatctttctgattttcaaagaaagaacccgtaaatgaaccccagatactagagctcattctattttccttagaaaagaccttgcttttcaagtcattattttcggattctgcaactccccaggtaccaaaaaaatcttcagagttaatatcaataggggtagtggaaggagcaatttgtgcattatcatctttaatatctaaagccttgtcaatcgttctctgtgcttctttcagggccgactttgcaatactagctaggcctgtggcatcaaaccaactcattttgattcatgggtttactgaaaaacattgaggagttaaagtaaattcatattgttaatgatttactaaatatgtaagaatcagccacagcatataaatatttcgtcaactgatatatttatttatccattccttacatatgttttgacagcag

SEQ ID NO: 124 - DNA, 3379 bp, Leptinotarsa decemlineata
  Annotation=Pre-mRNA-splicing factor ATP-dependent RNA helicase PRP22; Tribolium gene name from OrthoDB database=TC011820; Blast E-value Tribolium Gene vs. Leptinotarsa Unigene=0
atacatttatctgaaaaaacaatacgcttgaaacattcaccaaagcactcgtggactgtgggtctggattttctgattcttttattgctaatctactacgaattattcaacacatgaaacccccaaaaaatcagtcgaaggaagaggctgccattactcaaaaggaagtattagccaagaaatttccaggattatccattcctaatgagcctcagaaaccacttgatcttgaaggcaatgaaaatgacagcattgatacagatattgtagcagatatgatgaaacaatttgaagcaggatgcaccttcaaaaaaagatatcattgaaaaggattcaagccgaagtaaagatggtaaaaatagaaacgatagaaaaaggtcaacttcccgacacagaagtagcagaagatcaagaagtagatcacctaagagacgaagattaagtcctaggtcttctgatagcaattccagaaaagaccaagaacttagaaaaaggtcaagggagcgaaaaagatctatagaaaggggtgatggggtcagatctagagaaagaaggggtagaagtagatcaagagatcagaggggtagaagtagatctggaactagaagatacagaagtggatcaagaggaagacaccaaagaaataagtcaagggaaaaaaggagagagaggaatccggaaaagagaaaactagaaagagatagccctgaggatgatccggttcctggaaagatatattgtggaaaagtttcaaacattgtgccatttggatgttttgtacaactagagggacttagaagaaaatgggacagactggtttatatatcacaacttcgaacagaggggagagtaaccctgtctctgaagttgtttctagaggaagcaaaattaaggtgaaagtactgactgtgacaggtcaaaaagtctccctgtctatgaaagatgtttgccaaatgaccggtaaagatttgaaccctcactctcatgctcctttggagcgtgaagataaagatagaaacccagatagacctgcatacagtagcacatcagtgctgagacttcccgtaagcatcgatgaaggcgaggaggattcaagaaaaagagttacgaggatttctagccctgaacgatgggaaatcaatcagatgatatcatccggatgtattgacaagagtgagttgcctgagttcgatgaagatacagggctgttacccaaagatgaggatggaggcgaagcagatatagaaattgagttagttgaagatgaaccgccatttttacaaggtcatggtcgagctgtgcatgatctgagtccagtacgaatagttaaaaatccagacggatctctagcgcaggctgctatgatgcaatctgctttagctaaggaaaggcgggaacagaagatgctgcaacgagaacaggaagtcgattctcagccatcaggaaaaaataagaattggatagaccctcttccagaagaagaatccaaggctacaactgtccgagggattggcttgcaatcacaagacttaccagagtggaaaaaacatgtgataggtggcaaaaaatcttcatttggaaagaaaacaaatctatcaataattgaacaacgtcagtcacttccaatttataaactgaaagaagaactaagaaaagcagtcactgataatcagatcctcattgtaataggagaaacaggatcaggaaaaactacgcagatcacccagtacctggccgaagcgggactaactgctcggggaaaaattggatgtactcagccaaggcgtgtggcagccatgtctgtggcaaaacgagttgctgaagaattcggttgcagattagggcaagaagttggatataccatacggtttgaggattgcacgagcccagaaacaatgatcaaatacatgacagacggtatgttattgcgagaatgtctcatggacttggacttgaaacagtactcggttattatgctggatgaagcccacgaaaggacaatccatactgatgtactgtttgggctactcaagcaagctgttctgaaacgaaaggagttgaaactgattgtcacttctgctacactggatgcagtcaagttttctgagtattttttcaaagctcctatttttaccattcctggtaggacttttccggttgaagttttatatacaaaagagccagagactgattatttggacgctagcttggtgactgttatgcagattcatttgagggaaccgcctggtgatattcttttgtttttgactggacaagaagaaattgacactgcttgtgagattttatacgagcgaatgaaatctttaggtcctgatgttcctgatctaatcattcttcctgtttactccgcacttccttctgaaatgcagacacgaatttttgaacctgcaccaccaggcagcaggaaggttgtaattgctactaacattgcagaaacatcacttaccatagatggaattttctacgttgtagaccccggattcgtgaagcaaaaagtttataattctaaaactggaatggattctttagtcgtgacacccatatctcaggcacaagccaagcaaagggcaggacgagctggacgaaccggccctggaaaatgttacaggctttatacagaacgggcatatgggacgaaatgttgccaaccccggttccagaaattcagcgaacgaatctaacaaccaccgtactccaactcaaaacaatgggtatcaacgacttgctgaattttgatttcatggatgcaccaccagttgaatcactaatcatggctttggaacagcttcattcgttatcagctttggacgatgaaggattgctaacaaggctaggtagaaggatggcagagtttcctctagaacccaatctttccaagatgctcataatgtcagtcgatctactatgctctgatgaaattttaacaattgtcagcatgctctccgtgcagaacgtcttctatcgacctaaagataaacaagctttggctgaccagaagaaagcaaagttcaatcagcccgaaggcgaccatctcacccttctcgctgtgtataatagttggaaaaacaacaaattttccaatgcttggtgttatgagaatttcgtccaagtaaggactttgaagcgtgcccaagatgttagaaaacaattgttgggtattatggatcggcataaactggacgttgtatcagcaggaagaaataccgtgaggatacaaaaggctatatgttcagggtttttcagaaatgccagcaagaaggatcctcaagaaggatataggaccctggtggatggtcaagtggtttacatacatccttcaagtgctctgttcaacagacagcctgagtgggtgatatat

SEQ ID NO: 125 - DNA, 3181 bp, Leptinotarsa decemlineata
  Annotation=Translocation protein SEC63-like protein; Tribolium gene name from OrthoDB database=TC014647; Blast E-value Tribolium Gene vs. Leptinotarsa Unigene=0
ttttatgttgaagcttgtggccggtcaggagatgtcactttaaattttgacacgtaccccaaatcattttaaataaagagaaatgggccaaaaatttcaatatgacgagagtgggtctacatttttctatttcttattatcatttttagtacttgttctgattccggcaacattttattattggccaaagaagaaaaaaagagatatatcagaagagaataagcaatgcaaatgtccaggatgtgtgtcaaaaagagaatatttgaaagcagcagaaccatggaaggggccaaagaatttcctaataaaactcatcataatcgctggctggataattttgattttgttggcttacaaagtctcccagtttgattatgaaatggctaactttgacccctacgaaatcctgaaaattcctctaggcgccagccagactgaaatcaaaaaagcctacagaaaattgtccttgatacttcaccctgacaaagacactggtaatgaaaaggaattcatgaaactcacaaaagcttaccaggcactgactgacgaagaggcacggagaaattgggagatatacggaaatcctgatgggcctggagctatgagttttggcatagccctaccatcttggattgtagagaaagaaaatagcgtttgggttttggggttgtatgctcttgtgtttatggtagctctacctattgtggttggtacctggtggtacagaagtatcaaattcacaggagaccaagtacttttagacacaacccaactatactactatttttttaataaaactccaaatatggctgtaagacgtgtgataatgattcttgcagccagtctggaatttgataaaaaacgtaattctgaaatcattgaaagacagtcagataatgaagaaataccacagcttttcaaaaaactgcaaaatttgggagagaaaaataaagaaaggccactttgttacttgtacagtataaaagcgagggcaatcatccatgctcatttgagcaggattcctttaaatcccatcacgctggagcaggacagaaagtatataattggaaaatgtccttatctgataaacgaacaagtcaattgtgtcaatcagctcataatgttggcatatgcgagaagaattaataaacttcccaccatagatacagtggaaaattgcatgagattatgtccgatgatagtgcagggtatgtgggaattcaagtccccacttctgcagttgcctcacatcaacgacgataatctcaagtatttcttgtctaagaagcgccaaatcaaaactttgcagcagtatgcccaattgaaaggggaggatcgtagaagtctgctgagaaatttgagtgaagatgagtatgaaaatgttatgaaggtactgggcaggatgccatatatagattttcagactcaagtagaagttatggacgacgaaaatccaaaagaggtaacagctggggcgatagtgaccgtaacagtaactttgatcagaaaagacatgagtacgctgttcggagatgaatctgtcaaagaagaaattcaaatcacagagaatggaattgacgaagttaaagaaggtgtgggagaatcccaaccaaatgaacattctgcgaaacgtcctgcatggatgaagcaaaaaaagggcggtaagaaaacaaaaaaatcaaccaaaccatccaataaagttgcaagtgtaccaaaaccaaaggtagaagagtcacctattcccacgactgatagaaaaaaagaaaaaccgaaaccaaaggagattattaaaaatgatcaagatgaagatgaaacagatgagtcagatgagagcgatatcgacaatgaaactaatgatagatcctctgcggaagaagatgcgatcaaaacgaatgaagacgatgatcaggaatgggagaaattccgtaaaatacacgatagagaaaagtctctggaaggaaaatctaaaacctcccattctgttcattgtccgtactttcctcaagaaaagcaagaatattggtggacatatatttgtgacagaaagtctaggacacttctcacagctccttaccatgttaccagtcttgttgatagagagatggtgcatttgaagttcactgctccaaactggcctggtatgtacacattcacagtgtgtctacgttccgactcctatctgggcttcgaccagcaaagggacattaaactggacgtgaaagaagcccctgccgagattacggagcaccctcagtgggagtttgacgactctgaagaggaagatcctgctgagaacaatgaccgcgagtcagaatatgcgactgacgatgatttaccagaggattagtaaaggcaaagtatcggaagtttgctatttgtatttggaaaagctgggagcaggtggatctttttatagaggaattttgcagggaagattttgaatgtatcagttttgaaagatgatacatttttttcatttggtctgaatttatcaagaattttagtcatgctgaagtttttcagtctgtcaaataaaaatctgagcgaaagctgcaacatcaattacttttcatagttcttctttctatttgttttccacaaaatctactgtagacacattttttaaattgtttttttattcagcatcttcagttgtttgggcaatctctcacctgttttgtgacaaatttaaaaaaacaaaccgattttaaaatatttgtctagaaattcgaaaagggagtattgaaaatcccgaaggcttttttacaaatttgaataaataatacttcactctaagatcaagtatagatcattttgcctatgaagtaacaatgtgcaactgtggcaaaaaaatgttataatgttgatgaatttattaatacaatttatgttgtagaaagcaacttgagtctcatgtttgtcagaatgaagctctaatctcttgtcaaaaatcaaatgaaagcctgggttttcttggtttttgagagaggagcaactcatttagtaacgggttcttgttcagatttttattcgacagatatggcgttttactagtaaaattcataatattaaatttcaattgattaagggaagtactgataggttctgtgtgggatttcacgggataacttcaatattgatgtatatttatatttgtattaaaaaataatacttgaagttc

SEQ ID NO: 126 - DNA, 1087 bp, Leptinotarsa decemlineata
  Annotation=Tubulin-specific chaperone C; Tribolium gene name from OrthoDB database=TC008402; Blast E-value Tribolium Gene vs. Leptinotarsa Unigene=2E-121
caataacagtagatagtgtaactgataaaaccaacaaattgaatttcctaaccaaaagagagaatgagagaaaacataacttacagaaaaaacgtgaagataaatgcctaacgtcagctaataatgaacaactagatttttttgaacggttattcaacgaaaaacacacttatatagaggatatgatcaacctttctaaaaatgtaccaaggattgagttgttgaatcatttcaatatgatctcgaaggaaatattaactttgcagaaatacgtagcagcttctaatatatttctaagaaactatgatttacagagatgtcaatttatgcttcaggagttaaccttgaaatccaaacagcttgaagatgagcttctgccaaagaagaaattttctttcaaaaataaatcaaaagaaaatggacagattaaaattccagaaaagaaggaacattttgatgaagttgattttcgatcaaaacgttctattgcaaaaaacttgtgtggaatcttcaataaaagtaatgaggtactgatattgaccaatcaggatattttcaaaaaagatgtcacattagagaaactggaaaactgtaaggtttttttgaaaggtagcccatcgactctacatctggatcaacttaggaactgtcagatattttctggacccgtgtcaacctccatctttgctgaaaactgcgagaactgtactttagtaattgcttgtcaacagttaagattgcacagttctagaaacaccatcatttatctacacgttacgagcagagccattatggaagattgcaaggaaatctctattgctccttataattggaagtatgatgaaatcgaagatgatttcaagaatgcctctctcaataaatcaacgaataactggacctgcattgatgacttcaactggctgaatgaaaagcattctccaaactggaaggaaattgaagaaaaggatagagtctccaattgggatgcaatatagtattttgtgaaataacttatgtaaatattgaattagaaaaaaaaaaaaaaaaaaaaagtctaactagacgttagaataaccaactgacttct

SEQ ID NO: 127 - DNA, 2020 bp, Leptinotarsa decemlineata
  Annotation=WW domain-binding protein 2; Tribolium gene name from OrthoDB database=TC005552; Blast E-value Tribolium Gene vs. Leptinotarsa Unigene=6E-8; Blast E-value Tribolium Gene vs. Leptinotarsa Unigene=0
cagtgatgtggatatagaacaaccagtttttggagctaattacattaaagggaaagttcgtgcacaacctaatggcaattgggttggagaagccaagttcaagattaccttcaagcacggtggggccattgaattcggacagtctatgttgagggctgcacatttggcatctagaggcggaatgtgcagccctcaacatagactgtccgaattcaatggccccactattctagaagtcaagttgaattcgtcactgtttagattgttaacgtcacgtcaatataatttttgtaattcataattcattttattcatttcagaaacctactcaactaaattttgtgttacagaataaacacttgcaatgtcgttgaatacggcccatttaaatggaggtgtcctaatccacaatggagaacaaatattattgttctcggaaaacgtaaatattgaatggtctggacagcaaattagtgcatttcaaggcactaaaaaaggaagcatttatcttaccacacatcgagttatattcaataaccagtcttcttctgatgaaatgcaaagtttcagttttcccttcatcactctcagtgatgtggatatagaacaaccagtttttggagctaattacattaaagggaaagttcgtgcacaacctaatggcaattgggttggggaagccaagttcaagattacctttaagcatggtggggccattgaattcggacagtctatgttgagggctgcacatttggcatctagaggcggaatgcaacctccaccaccatatgtacctcctcagacacaatggtatgctgctcctccaccagcttacgcaccccctccgcaaggatattatggatggtcaccacctaccaatgtttttcctcaacaaccgccatctaatggtgttttcatgacagatgctcctccaccatacccaggaattgttcctggatatcaacagaatggttatggtccaccacaaggtcagcagggtccaccaggctaccctggtcctggatatcctcaaggtccttctggcccacaaggagctgcaggtggtttccagcagtcgtttggaagttctgctgatgccaaggctgccgaagctgctcagtctgcttattatgaccctaataaaccacaaatggcatatattcctccgccagcttattatgaaaatccacccagctacaatcaggctactgacaaaaaaacacagtaggaatggaactaatgtggcagtaccagttaatgttttgtattatattgtatagctcttgctaactatcgtatcatctggtttaaacattccttctaatttgatgctggcaatatttttaatctggggatgaaaggtttcttggagctctatatgcattattcaacaacctttgtggtttaattttttgtatttgaattgaaatgtttctagttttttgcagacgcaagtaaaagtatcactttgtttcatccattcttaatcatgaaaatttataaaaaatgaatatgttgtctaaatagaagaatccacaaatgtttatgcaggtcatttaggcagcataagtattttcctaggattgaataaaaagctacccatattagtatttgcaaacgaaccacaatttgctccaatattgttatatatcttattatttaaaaaatatgtatctgaggtgatattatcaaaatgcaaacatacaccagatagtcaactttctagagctgtatttataaaagcaaggtaaatgtagcttgtggccactcatttccaattatgctcataaatcaccccactagagccttcattccacaccaaatactacctgtcaaacaagatgtgttgggttggctatgtttaatcataaatattataaaaaaattatattcatgtatatatttgttagctattgtattaactctattgaattaatcgagatatttgaataaaatcacaaaatctaaggaaaaaaaaaaaaaaaagtaaaaactctagacgttagaattaccaactgct

SEQ ID NO: 128 - DNA, 4489 bp, Leptinotarsa decemlineata
  Annotation=Forkhead box subgroup O; Tribolium gene name from OrthoDB database=TC004761; Blast E-value Tribolium Gene vs. Leptinotarsa Unigene=7E-16
gagacacgacccggcagtgagactgtgttgttcaaattcgttgcgaatcatatcgcgtaaactactgcgtcatatcgtgttccgaagaaacaaaacaaactgtgcggtgtctgtcggcaggattttgcctcagatcagagtgagtgttgcgacaattgacggtgatgaattgctgacttgtggatctgtggttcagtgcgtgaattgcgccgcaatttataaaattagctcagctcaaataatcctataacctgtgctgctgccgggtgattttcgagttaggtgcgaacgacgtgcggtttatatgaacgggcagtacggtgcgtggcctgtccaaaaaatgaacctggatatcatggaaccgctcgcagaacacgacggtttcgaaccgcagactcgcgcgcgctccaacacgtggcctctgccccggcccgagaattacgtcgagcccggcgatgaggcgggcaacaagtgttcagggctgcccgttcccgttcctgccgccacagtgcccaccaaaaagaattccagcaggaggaacgcctggggcaatctaagctacgcagatttgataacgcaggcaatcaagacgtcgcccgatcaaagactgactctgtcgcagatatacgagtggatggtccagaacgtgccctatttcaaggacaagggagacagcaacagctcggcaggatggaagaattccataaggcacaacctatctctccacaatcgcttcatgagggtccaaaacgaaggaacaggaaaatcgtcctggtggatgatcaacccggacgctaaacctggaaaatcggtaaggcgaagagctgcgtcgatggagacgagcaaattcgagaagaagcgaggtcgagcaaagaaaaaagtcgagaatatcagaaatggtttgccggacacaacgccgagtccaagctcttctgtctcggaaggtctcgatttgtttccagaatcacccattcatagtggcgggttccaattgagcccggactttagaccaagggcatcttcgaacacttcttcctgtggaagactctccccgataccatccgtgggggtagaacctgactggggcaaccccggtcagtacagtagttcgaactttagtccagagatggtgtccaccggtaattattcgcctgaccaacttgcgggaaatctccaacaagggatgaagttagaaccggccgatgcttatttggggtatatcaacggtcagacaccccaacctcctcccccaccctatactgccccctacgaacaatttccaggatgtagagatttgaatgccttacacgctgcctcaccgtacggactaacacaatgccctgtccatcgtatccagtcatgtgcttgcatgcaacctatcaaagtagagagtatgtcaccggcggggatgtcaccctcctacccccactcggaaccatctccggaccccctaggtagccaatacatgatcaacagaatgccgaggcctccatctagcagtcccccgctcaccccgcggccatctttgggcccgccttcgacgatgatgggccagttgatgggggcgctgaacaacagcgccatcttggacgacctcaacatcaacgtggagtccttgcagggcggcttcgagtgcaacgttgaagaattgataaaacacgaactgaacatggaaggtagtttggatttcaatttccccaatcaacagcaaggagttgtacctgcacaaacggaatcgcattcggtgatgacgaatacccaacctagtgcacctccaccttcgtactcgaccacggcgacgacgccatcatgggtgcattaacgtaggatttcaggaaaaaacttctgcaaccaaggaatcaattgatgtagattctgcgccgctgttttatctgttgtgcaaccgttgacagtgtaatcttgttataatgatctcgtgttatgctcattaatacttgtttgtacagaaataaatatgctttttatgtccataatattacaaaaatattatcactgcactggatggctcgaaaagtcgtataattcctgagatgatatttaccagtgaacgcactttagttccttacgaaatatgtttcgaaagtctttgcatctcagcagtagaaaacataaaaaaaatttgaagtttccaacattttttttcatatattattctcaagtaattatgttcaaccgaattacaatccctcgaaaccatacaacaaaggcttcaattcatttcataaataattatgtgaacttagatccgataatggtggtggccattccaggtctactgtttcgaattcacatattcagaaaatgtccatttagtcacactctaatcaaaagaatgttgttaatattacggtaataatgatgttattatgctagatggaaatgatgatgaaaattttgaaacgtgatgctcaaaatttgaaacgggttcatatacgtatgttataagctttcgaatcgattacaattaaaaaatacttcattgtcaaaatttactgtagaggatggaagctgttgcgactggttggccctcattcacaatattgctcttctaacttgtttttcgaaattgccataactggttgcaggtttcaaagttgtttgctaacgatataactgaaaaagaaagttatctttatttgaagttttctatccctgaatatgacatgtgttgtgaaaacacacctaacaaacagctagtatagtcgcccaaagtgtccaaagaaatgtattaataaaatacataatgttcacatattcatgtgctctttagacaataataatattttcaaacagaagaagttcacctctggtactttttcagtcatccagtgaaaatttctattcatttttatgttactggtgccattttctacactttaagttcatagatgccaattgatgaggttttgctaaaaatctgaagcggtaggttggcagctcaaattccctgaaaaaatgtttttcgatttataggaaatttttttaaatttgtaatttatatttaaggccagatttattatacataatgtaaaataagaataaacataatgaattaagaagcagcatcgcgttatgtcaaaataccgtcgaacttgtggagttcaaacgcacaactgggttgatcttttgcattttgttatcattattcatcgtttgagttactgattcatcagttttaagtcccggtttccatttttttttcttgtatttcgagaccaattcatcgtgcttcagatacactcaggaaacttcaacatttgatttttgtatcagagcacttatctctgaacatttcagaatactttgaattttcagttaatctttcgtttcctgaatatatattgaaaactccacatttgtacataatatagaattagttcttaggtgcttcgcgtaccttttgttgaattatttttaatttttataaatatcttttcattttattctcgtcatacggtactggtcatatacaacgttttgttgcctataaattaggcaccttatcatcatcatttagaatatttttttactgtaatatttgtaaagtgtttgatgtactgttagatgtgaaatgtctgccgctattttttctgttttagtttaattaaattaattaaagaataatggcggcaggtattggattttatcgtattaagttagttttgactattggatacgtattgatgtgtataaataaacaaagaggcaaagtaggagatgttttcgttgttagagaaaagatgggttttcaattatcatatgttagctgagggtcggttcaataatttcacatgaaaaagtgttcctgtgttggggtactggaagccatttatagaaaatagaaaggaaccttgaatgtcaactatctaaccgaacatttggacacttcagattcattaaaatctgattgaaatatttttagtgtatatttttgagatgattgactttcaggaactgacaaactattgattatcagtagtcgtcaggcaaatattcccgatcagtttacaatatatttcgaaagggcggccaaccgattctaattacttgaataaatatggaaacattggtcaatcatcccaacttcttataggtacaactctgttggttttatatttcggttatgagttttaatcaccctactcgtagattatgatttttagataaatatgacgcgttgagacacatagtcaattatttggaaaaataaatgctacatgtcaattttgagaataaggaatcttgtatgaaaactcataagagtgcatttggagtttgtttttaatgtgaacgaacctgttatgcatatctattgttttatttttccacagaaacactgtacttacgtatgcatgtgcacctcaaagcaacgagtgtactttacagtgatagccgctattcaggtgcctcaattttctttaaattcgttaatatattataaatactaattttaagaaaatatatgaac

SEQ ID NO: 129 - DNA, 1990 bp, Leptinotarsa decemlineata
  Annotation=Peroxisomal targeting signal 1 receptor; Tribolium gene name from OrthoDB database=TC011841; Blast E-value Tribolium Gene vs. Leptinotarsa Unigene=0
gagtcttgtgtttatcattaatcaagtcaaaagtcagttccatacttccacatgtaatattttgataaggttgttctacggagaaaaggtcgaattttcattagtttttaagtgtatattagtgaataataaatatataatggcattcagaccattaacagaagctgagtgtggtcaagcaaatcctttgtcgagattaacttctcatattacccatgatcatacattttctgagagtcatggacaagtgtttcaaagtagctctgaccaattggttgaacagtttctacaagaatccagagctgtacctcaaacgtttaggatggatgatttgatgagagaaatgcatgaaattgagtctcaaaggtcagctctaccgcccattcctgcatcaacagtcaaagatcagttacatgataattcttgggcactacaatatattgaagatggaaaaaggtttaacgaaacttcaaacaacgaaacagtgtggactgagatattttctcaagaagagagtcaaagagacttacaagctcgagctgacatgtggggtactgaaatattaaatgctcaacctggttcaagcgattttttttctattgaggaaccattgagttgttcacatgctgatgattcaaaatttgtatattctaagttcatgaaattcatgaaagaagagggtgatgttcacctagaggacggcaaattgacagaggtagaagcccaggaatggacaaacgaatatttcagaactgaaggaaaaggtgacgaaactgataaactgaaatccatagctgcagattgggctaatgaacatttgagatccaaagaggaagaatttaactcaagtttttgggatcagttgcaagaagaaatgaagaaagtatccaactctgatactgactcaacccagccatggattgacgaattcaattcttactacaatactccccaaaaggagtatgaatttagtgaagacaatccaatgttagatgtaataaaaccattagagagaggcaaacaatttttagaagaaggagattttcctagtgctgtattatgttttgaagcagcagcaaaaaaagaacctgaaaatgttgaggcttggttgttgcttggtacgactcaagctgaaaatgagcaggatccagttgcaatagcagcattgaacaggtgtctccagctggaccccactaacctcaatgcactgatggctcttgccattagttacaccaatgaaagttattacaaccaggcatgtcaaatgctattgaattggttgaagaacaacacgaaatacaacgatttggtgccgccgaatttgacactatccggagacgatcacaagatagtgcaagaattatttattaaagctgctcagcggcatcctcaagacgttgattatgaagtacaatgtggattaggcgttttatttaatctaacaggagaacacacaaaagccgcagattgtttttcggccggtctttctgtccgaccagatgatgctagattgtggaataggttaggagcaactttagcaaatggttctaaaccagaagaagcggtagatgcataccaccacgcattaaatatatcacctggttttattagagcgaggtataatgtaggaataacctgtataaatttgaatgcttaccgggaagctgcagagcatttcttgatagctctaaatcagcaggctagaggtaaagatgtatcaaactcaggttctgtatcccaaatgtcggacactatttggactactctccgtatgtgtatttctctaatgaacagaggtgaactcaagtctgcggtagataaaagggatttgaaagaattaaataaagcattttttattgactaaagaatcaataatatatgatcatcacatgaaattgaaaaggtggaattttgaaataaataaaattgttattttttacagattgtattgatagcaaaattattcattttgaataaattatcaattgtt

SEQ ID NO: 130 - DNA, 2216 bp, Leptinotarsa decemlineata
  Annotation=UDP-N-acetylglucosamine--dolichyl-phosphate N- acetylglucosaminephosphotransferase; Tribolium gene name from OrthoDB database=TC007854; Blast E-value Tribolium Gene vs. Leptinotarsa Unigene=0
taaataagatcttatttattgaaaataacataaaaaaagaacattatcacctccataatatactacaaaaatcaattcctaactttactgtagccccaagtttcaattatatgtatcaagaatcaaatccaattcaattctatggcatacctaaaacgaaaaaacttattacattttcgcgcctcgtcctaaactatagatggagctgtaaatctgcacgtgctttttcacagaatcagtattagtgatcgaaggactttatatatgccttttttgattctgtcaaaccacatttccgctctcaccgtgtgtgtgtgtgccgttaattcgttatattttcaactccatacaactccaaatgagatggtcattggcatcagaattttcagagactagatttttttttttcatttgccttgatttcgcagaggttgtcctcattatacatactaacaataaataataggatgtagctaattgcagacgaggtgaggtgccttataaaattattctaaaatgatatttaaatataaagcagtcattctttctttggaaattgtggtagctataaaaataagttacttctattttcacactatatacaatatatatatgcgtacaagctatggggttgttctgaaagaaatctttccaaaataagcagtcacatacatatcatacaggtctgcattttctacaaataataaagacaaacgaaacgaaagtcatacactctgactttaatttggatactagaagacctatacctgagtccattatacattctgacggcatctctgaattattattacctcacataacttttatatgcaaaatgaacagtcaagtatagataaaattttggtgcaacactcgtcttgtgtcaaagatacattcgaaactaggtcagaaattcatattttaccccaatcaagattagaaattcacacctacaacacctaaacatcgtaaaaaatagacgccaagggatacctaatcacaaaagcaacacctgtgaagaaaacctgaatggctatcagaacgctggtcagctttgcttcgtgcaatggacctaagtatagcagtaccaaattgattaaagtgagattattagtaataacgcatccgtctttagtctcctgccacctaatcaacctgaacatcctgaagagacttatcacgaactttcccagaaggttcaactccgagtatttgaacacagtcgtactgatctccatgcaatctgttttggaattgaacctcggtagcctgtgccgcggacagggaatcagacgaaatagctgtggagaggagtacaggaagttgaacacttgagggatgaagaagagtaaagtagttttgctgaaatggcccaggatgccgacgacggcgaaagtcataccagaaaagtagcagaatgtgtcgccaacgaagactttcgatgggtaccaattgtgtttcagcagagccagcgtagtggcagtataaggcaacatgaagtaaagactgaacaaatgggctttccaaagagctccattcaactccatcacattgaagatgataattgataaagcaattacaacactttgcccagtttctaatccattcacaccggcaagaatattgatagcgttcgtgcagaaaaccgccaacatccccatataaacataataaagcaacccaatgtccacagagaatccgaaaaagtctctgaaaggttttggtacgactatagtcgtcgaattgaaattaacataatagaccatcaacaagggtaaggatgctatggtgggaagcagtagtttgtgtctccagcgcagatccaaaacgtcatctgcgaaaccgagcaggagcatgcagcaaatggacaacagcgctgcaataagttccacaaattcgtcatgaggaaaatcgccgttgaaaaggctgttcccgaacggaatcggtatgaacagaaacatggtgactaggaaagagcatcccgatataacgcccagagattcaggcactttttcgctggtcgtcttgctcatgtcgattccgaacaagttggctttgatgaacttgtcttttattcctggaattattcttactgtcgctaagtaggcgacgatagacattaccgtgtttataattattgggaaccacattcttgccgaattgaacgttatctctgtgtttacgtctgccgccattttttaaatgagttgtcaatc

SEQ ID NO: 131 - DNA, 2027 bp, Leptinotarsa decemlineata
  Annotation=CG8420; Tribolium gene name from OrthoDB database= TC012466; Blast E-value Tribolium Gene vs. Leptinotarsa Unigene= 2E-132
gttaatattgtcatcgatatcttcacaaatcttcaaatatatacaaactacagaattactattaaatttattacaactattttacaaaataaataacctatgagtcgatttacagaaatgtttgctgtgactttggaaacacatctataaagcaagtatgccctggaattgggaaaaatctaatttctatagttcattgtgaacgtattcagttgttactctcagttcttccagatggaaatcgtgacacttttctgagtacaatttcttgcaattcgtttcctgtacaatatccgtgtataaggtccaaaatggcgtttctgattcagcgctcaagaaccatccggccatcagacttgcccctcgatacaagagttttttgaggcctggtaagctttccaattcattttgattttcttcgttgactagacacaaaacatacctttcacattgtgggactactttggagaatcgatatgccctattgacccttgccaaaggttcaataatctccatgttgattgtatctgctaatttgtctgctaattctttggagttgctagagtcgcggaccgatccatagttttctgccagacgtaacaagtcctggatataagcaacagcgggttcaacgtactccttggagtcgatgtcgatttcgaagtactttttggcaacgtgattcgagaaggcggtgatggtttgaactggccttgcagggtcaaacatggcagctttggggaagccctgcatcttcaagtagctgttcaagaataattgaccgctggagaaatatgctttataaaccttgggatcagaagcgtaatgcagaaactccgccaccctgtccgtgatcatccgaatccagtgccttctgaacgaatgattctccatcatctccccgaacttctggtagctgaacttcccctcctcgtccgtgaaaaccttgaaggtcttctctgccccaagggcactaatcacgtacttccccatctccgagtggatgaacagatcgaacatgatgtgcgccttttctagaagaggaggcagagcccaagagtgctcttcgtggcgttttgccctcttgtgagcctctggccctgaaaaggcgctgatggtctgcatgatcagcggtagatagtccaagaagttcccttctcccgacttgcctgtccctttgcccaggaaattgctcgccatcgacaccaagctgcctaaatcgaactccggggcggatttgcctttgctcttctggccggatttcttggaggccttcgcctttttgggcttgtcctgcgtctgggcgaacatgttcactagagatcctatcatggcagggtctattcctccttggcctccctggccgcctaatagggagcctaagccttggagtagggctcccccgccatctgctcctcttcctcctgctgctccttggaaggctcccattagggcgcccaggccttggagcaggtttgcagcgttgtcttctccatcatcattcgatttcttctgattgccacccactaaagaccccaatccttgcagaagctgaccagcattcgcttttccaacattagaaagcacatcaccgatcaaattagcgccttcgccttccagaaaattctggaacatcgctccgagattttcaacgttctgttttttcaacacttccgatactgcgtctgcgtacggattggactcatcttccttgattttgttgttttttgtgtcctgcaacgactggccaatgcagttcacgatgactagaacgagaaagaacttgctggccatttggtatctttgcttctgaaataatctacactaagaaactgtccacgaatttcccactagtccagaattcggaaaactcgcactcacataatcaccaacgaaccgcttggacttggtagacttcccaagtactcgttgtcgctgacgtgaacgtggacgcggagtaaccacctgtaacggtacctctgaacggtgctggaaccacactaccttcctcgcgagcgagacacctc

SEQ ID NO: 132 - DNA, 1799 bp, Leptinotarsa decemlineata
  Annotation=PX domain-containing protein kinase-like protein; Tribolium gene name from OrthoDB database=TC008957; Blast E- value Tribolium Gene vs. Leptinotarsa Unigene=3E-61
gtatatggttcatctttatgtttcggacatgctgtctcttaatctgacgattatctagaggaattctaattcatttttaattcattgaacttaatcaattgaaaagcctaggaaagagcatgcaaataaataagtgtatttataagaaaataattttaaaaatgctcaaaataatttaattttttataatcaattgattaatttctatgctttttaccacttttatttgtaactaacgttacttatatattgtataagtttgaaaatgtccttataggacgaaactgcagttacgttagttacaaataaaagtggtaaaaaacatagaaagtttaatttctcttttcttcattatgatttcctaccacgtagtaacggctacatccatcaatttattgacttcctattaaatttggtcttttgttgtattgtcgccatattgaatttggagaagatggcttcaacgccgccattttgaatagaatggtcaattgtgtcatatcgttggaaagagaattttattccacaaaaaattacctaaaaaatatataggattctgtttaaatttctcgacttagttaatttctggttgcctcgacacaggtttttgatttcttcatcattaaaatcggctccaatgaaatatacctttgttccgaatgtcttgcccgacaaacaaccggatggcacagtgttcaataattttgtcgactcctccataaaacaccagggtatatttatgatatttttgtgactttgtgttcatatgtttctgtttatattttattttacataatttcttttaaagttactgttaatttcatctatattcggctagtatgcttattcgacaagatttagtcattataataataataacaacttatttccttagacaataaagtataattattatcattattgaaacagactgaaaacaaccctcaggaatttcgaatcgtgtttctcagcatattcattcctctaatagcccttgcaccgacccgaaccagttattgatatacacattcaagtgacgcattccgggacattcacatgaaaacaaaaaattcttatcacatcttcaataatatttacagtctcggctggataattcaggaaactttggttttgcgcaacgacgacttgttgaagttgcagatggcccccagcagctgggaacggtctttgtcgacgcccggcatcgtctgtggggccccgttgatcaaggggggcggaggtggcgggaccggcgcgtccaggagagggggaggtggcggaggctgaggcgatggtacgtttgaacctgcaatcgaaggaggtgtagcagtaccaacagaagtggctgcgctgctattcaaactctcaggtcgatccccgttcacactgttagctttttccaacttcttgttttgcttgtgctgttctttagccatacgctccattttgtgcctatgcttcttcttctcctcttcacagctcatcatttcttgtaccctcgccaaacgtttctggcttcgcaccagcttctgttcccctatcagtctttcctccattttggctactaccgacttcagctgctccttcgtcgagctggggatcttgaagtgagccctgtccgtaggcaacaggcttagctgcacaaatgaaaagaacggatccgccaagaggtccataattttaggaaggccgtttttacacgcctcagtcgtcagaattttaacgaggatgtttctcataggacaagctggaatattgtcagcgatactctcatgaagcggggctccaaacatcatctc

SEQ ID NO: 133 - DNA, 2792 bp, Leptinotarsa decemlineata
  Annotation=Nubbin; Tribolium gene name from OrthoDB database= TC003196; Blast E-value Tribolium Gene vs. Leptinotarsa Unigene= 1E-36
tggtgaccgcaacaaacgaacaaccaaggatattaacgccaaattcgcaatcacaagtctctagttcgagtcctggggtaggagcagccctggcagcgttaggtggtctaggagggattttcggtaatcatctgcagatgttaggcagcctttcggccttccaaaggccgcaaaatctacagcaattgcagcagttggccatgctgcaacaagcgagcggaaatcaaataaaccaacaggctcagtttctgtttcaaaatcaggtacagcaaatggctgctcagcaattacagcagctgcagaaagtacaacaaaatactagccaacacaacaccagcattacccaaaacgcacccctacctcaaacgcaaacgacacctccaaacaacacccaccacataccagccagtatactcactcccagtacgcccagttcggggggactgacgccgcagcacctaaaaaacccttcacggctcatggaaccatctcccgaagaaactaccgatttagaagagctcgaacagttcgcgaaaaccttcaagcaaaggaggataaaactcggattcacccaaggagacgttggattggccatgggaaaattgtacggcaacgacttctcccaaacaacgatatcccgatttgaggcgctcaacctaagcttcaaaaacatgtgcaagctgaagcctttgctgcagaaatggctagaggatgctgacagtacgttgagcaatcctggtgctcttagcaaccccctaacaacgccagaaactattggcaggagaaggaagaaaagaacatccatcgaaacaagtgtcagagtagctctggaaaaggccttcatgcagaacccgaagccaacttcagaggagatcacaatgctggcggataacctctgtatggaaaaggaggtagtccgagtgtggttttgcaacaggaggcagaaggaaaaacgaataaatcctcctacagccagcatgggatcaccatgctctgtcggcaacagcaacggtggcatgtttcacatcgctaacagtttagcgactagtcctctatctctggtgacatccagcggccatagttataatccgaatgtgatggtcaaacaagaatgaccccaactgaacttttttgcggaccactatttggaatagtgggcgtattcgtgcaatgatattgaataatttcaacgtatactgtttccaggttgtggttgtaccacaatcgacgactgttcagaaataaaacatgccaaaaatgtgaggaaactgctgtttgtcagttcactacacattggatctcagtgtcaacataatcatttacttggatcaagtaattctcctcatttatacaaaggcagcactctattttgtcgcctgtcttccacttcgatttaatttcaaaccattggcgttgcgggactgcgtgtttttaaagttattctgctgactgtttttgttatttatttatgccaaatatacttatgtccatatagcttagacttaaggttgtcgcattttgtttcatagctattatattttaacgtttgaggtgtacagctatactgtaaatatgaaaattatcggttgctattctttttcgtgagttgttaaaagaattgttgagatattagcagatgacattcactcgttaagcagggtctcatattattatctatttgaatgactgtcacttgctagtcgtgtacaatttgtagataaatacatgttatgaaggtaaatatattattagcattctagatagatatccgtttagcatctggtgtatatgatcaactcttcgtgtcagtgtatatattgaatttagcggttcttttttctacgaggaccaatatagaaatgtttaaagttcctaataagaaataatcattgttgatattattattgaaattgctcgtagagtaccacaattttccaatattttatttaataccgcgaagtttcaaatcacaatagactgacggcgtcttttctgtttgaagacctgaatattgggaagaatagggtctagtttttttaagttttacacacatatatttacctaatactgttgtttttaacataatgaaactatttgaatcatatcacttgaaaggaattttccataactgctatggttcaattagtaaaagtttggatacgaatacctacatttctttgccggtattcgtatgcagctgatttggtattttgtaatacatataaacgttcaaaagtcagttgttctttactgccatatctagctcgagctaggtttggcaagtattacaccaactggacttagggaatgttcaaaggccaatcttctgaaagtgatcaacatatcgtaattctttagctgtatagtattttaaagttatcttttcagcctgtgaacatttcagatatccaagtcatatcaatgtgaattagtgtaagatacattatcttggaacgataatatcccaactaatgattttaattcggtctgaagtttttaaacactccatagaacattagtcctgtaggtatatgtgtgtagtatatgtgttagaggttaacaactatggccagaaaactgaaggtttcttgaatccagttgcactccaaattggtttacgactttttgtacaataaatgtaatggtaaaatcagttatatagatcgatgtaagtattagtgaagtgagaaacgatttcgaaaatgtataagaccctattcagaagtgtaacatatacaactgtggtctaggcaataacatgtacattattttcattaaagaaatgaattcac

SEQ ID NO: 134 - DNA, 3298 bp, Leptinotarsa decemlineata
  Annotation=MOXD1 homolog 1; Tribolium gene name from OrthoDB database=TC005328; Blast E-value Tribolium Gene vs. Leptinotarsa Unigene=0
gatatgtatttttgaataccaacttcatgatgatgtacaactcgattatcttgatatttttactgtattcctatcgatgacgatcggcctcgccgaagatttgttggaccaatatgtgaaacacgtcgaaaaagtcaacagaatatcgtacaatggcggcgaatcgaacgaattcccaaagccctctcacgaatacaaccacccgaaaggacgatacttaacgagaaatctaaaagttgctgtggaggaatttgaagaaagcagcatttcttcggtagacccttcaaaagttttttccgatttggacagtattcgggaacgcagagacgcgtccagcgatattttgtggacccattcggaggttttggacgacgaaggacgagtcgtcctcaggtggcaaccgaggcatcaggaaattctgtttcgagtcgaggctaggacgaggggatacgtggggctgggcttcagccccgatgggaaaatggaaaaatcggacattatactcacctgggtggacgatagactgaatcaaccctttttgatggactgccatggcgttccaaagagtcaaggcagcgcacctgttaaagacgaaatggataattacacgttgatgagagggatccaaaatgacacccataccattatcgagtttaggagagcctacgacacctgcgatccggatgattacgttttatcgagtgataccgtccatatgatatgggcgctccatgacaatgatccacctcacggagcagagatggtctaccacgaagagagcagagggtctcagagcatacatttactgggaccccctccggtgatgagaatgcccgttggccattccagtcaatggaacgtcttgtttgaaaacctaaatgttcccaacgagatgaccaccatgtactggtgcaagatattcaaagctccgacgctaaaaaacaagcatcacattgtcggcttcgagccactcatcggtcgaaaccactccggtatggtacaccacatgatcatgcacgaatgcgatctggacgactccgacgacgtagcggtttgggacgctttctccaaagagggagggagactgtgctacgccaacatgcctcccttgtgggacaagtgtctgacgccgctggtcgcttgggcggtaggatctaaaggtgaaaattttccaaatcacatcggtcttcctctggcggataagaagaattctttttatatgctcgaagtgcatttcgacaatcctactatgagaagcgcctctgatacatctggcctgcgactgcactacaccagcgagcttcgacagcacgagggcgggatccttattacgggagtggctccatcgacgctgcacttcgttcctccccatcagcctgaatacaaaaccgctggctactgcagtgtggactgcaccaaagaggtgattccaaaagatggcatcaatgtagtatccgtcatgttgcattctcattcagctgctagaaaattgaagctgcgtcacatcagggctatgaaagaattgtcgcctttagctgaggacaatcattacgatttcaactaccaacagtcccgccgcttatctcaggatactctaattcttcccggcgatggtctgatcacggaatgcacctactccactctgggaagggataaacctactctaggcggatattccaccaaagatgagatgtgtcttgcttttgtattgcactatcccaggacacagctctcgggatgttattccatccctcctgttaaatatttcttcgaaacactcggcataagggaattttatggaaaggatatggtcaatatcgagaaggatttgcttgagggaaaaagagaacctgaacctttgccaactaccacttctaaaccgttcattatcaaacccggagatgaaaattcagaagaagccaaccaaagagcgattattgctttgaaaaatgctaaagagtacagcatagatggcgaatccagcgagagacacgtgtttgataagctagtcatcaaagagcccgccgaattcaaaaatttaactttcacagaacacttgcacaacatgccttacaatgagactgtcttcactaaaaagatggaagagtacttttacaagggtctgcatttgaccttttgcaggaaaagagatgatagtttgatcattaaggaagatattgtcaaactgccggaatttcaagagtttcagcacagggagaatattcagtgcagtcaccgaacgaaatcaacagtctttgctgcaacattagattccaattcaactggatcgagggtatatccgtatcagctgtttccttgcttacttctcatttctatcatcgtattgaaagtgatggtttcatgatgcactttcatattagttgaacagttaactatatgagttttcttgaattctaatttccatgagtttatgatagaaatttcaaaaatattctgatgatcaattcccaacaaggaaatattttaaaaggtgcaaatgttaatccttttgatcattatttctgcaacgaatatttttgctctttttgcaatataacaaaaataaagactccaaccatcatctgatattcctcatgttgttctagttcattattgcatttttactgcttaatattgcccttcatacttgcgcgatcataaagacgaaaaatgtgactaaattattaacagattttattgaataaattgcaaaatttgaaattgaagttgagctacaatatttttttgtcaattagtttgtaatttgtcatattctctgtctcaattccttacggtagtaactttcctgttgttttctatgctttgtttgcaatttcttcaggaaatccgtgtttttgcaccgttactcttgaagtttgattggaacaaatttttctcaacaaataaatacaaaattttcggaataacaattgtggcccaatgaaatgaaaatgttaaaatcaaaattatttttcaattttatataaatatttacatgtgaatgcaataacggactaaaggacatagaagtcgaccataaacatctgcttaatactcttgataaattaataacgattgatggattcgaatttgttttatgtatatgcgaacacttattgttgaaaaatacctctccgccaacttttatttatttattgttttttatttatatgaaatccacctgtatatatctaagtcattgttgtacattttaccaaatagttagtatgtaaggaataaatctaaaaagtgctgtgaaatctgaatgtatccttttttgtgtcttagtgtctccttg

SEQ ID NO: 135 - DNA, 1356 bp, Leptinotarsa decemlineata
  Annotation=CG4553; Tribolium gene name from OrthoDB database= TC004532; Blast E-value Tribolium Gene vs. Leptinotarsa Unigene= 2E-81
aaactaaatacatgacccagaaaatttcaagtttcttgcagagaaagtagttttgagttgaaataactgtatttttaactttcaacaatgaggtgcttatgcagatcatttttgaaaacatgaaaacaaaaaatatatgtatttttattcaacccattccaggaaccctatacaaaaattctccatcataatcataataacaatcattcagcctatatgtgtagccccttttgactttatcactagggatttgtatcttttctgggtaaatcaagtgagagtagtctcgtacagtttttgtggcaattgctcccccactctctgtgttgtatttgttttgaagtgcaaaagagtcttcctgatacatgagtggtgctactacctgctctttcggttctttgaagtcatttagtatgagtttttcgtcctcggaaagttgacttcctttcaatgctttctgctcgatattatcctgaagctgggataaggtaacgtcccttctatctttcatttcgtttttaggaactgtgagaaaggtgtctacatggctggctttcagaaactttttgggttcctccatggttatttcgacttcactttctatttctttgtttttgttcttcaattttttgtagcttgttattatttctgagaaatcagaaggggagctttgtttcgtaacagttatttcgtttttgtttgttggttttatgaaacgcttgaaagtcaaagctctgtttgaaaatttgttcagatgctcaactagatcctttggtaaatctggaaattccccttttttgaaactttcccagttcctttgaactgcagcatcatggtttgcaatttttgactcgctcttcttgaaattcgcttcaacgatttttattacagtatctggcaatgcaggaaaactttcagacagtttttcgattgtccatttttcaggatcagtagcatacaggtatttcatttgctctttatcatgccaagttaaaaaattcattttcttttcgttgaagtacttttgtctgactatgaagtatttttttgttcctccattctttccatttcttcaacgtgtgctctgtgcgtttggtggacgctcatgaaatccgattctaggccttcaaaatccaagtcttcctcctctttagcatccaggtcgtgagctaagatatttcttcgcctctgtattccaggattagttttccttgggattattctattgtagtgtcttaagccattttgaattattctatcagattttttcaataaaaacatattaacgcagttttcctaaatataatgatttagataattcaagaatctgtccttcaagtttcttatgacgaggtt

SEQ ID NO: 136 - DNA, 2981 bp, Leptinotarsa decemlineata
  Annotation=Transposable element Tc3 transposase (Fragment); Tribolium gene name from OrthoDB database=TC002531; Blast E- value Tribolium Gene vs. Leptinotarsa Unigene=6E-24
acagctattaactatcagagaataacaatttaataacatagatgccctaaaattaagttaaatctaacatcattggcacttcaaatcgaaaacacttataacaagcagagattcaaaatataaaataggtcaagttgagttgaataaattaaaacataataaaaatatctacacataagtagtagagggaacagtgaagtttgtttataaggttatgatttctgaatgggtttcagaatagagtgaactctgtgctatagttactgtttagtaaaatatatacaggtgttcaataaacatgcggcaaaaaattaagggactattctaaggatattttatctttgatgatttttgaagggcactttgtttcgaagatacggggtgaaaaagaacttcgacaataacaattttggtaattttaaaattattaacgtagccaaaataaaagtatagcgtactacactggacctaccaagtaataaaaaatctaacaattccattggtacctatgaacaacattccgattactacaaactgctgcagacattcaatttgaatagtatgtctcataagtgatcatttgtatgtgtcgaataggttgaaactgattgacttttcaatttgacgtgcattttctgtttaatatttaaagtcttgttaatgaagtcctgtatcacgaatggctatagtaacacagagatggctgacatgcatttcatttatggacttgctgatggacaatttatttgaagctaggcagttgtacagtgaacgatttcctaatcgtaatgtgtccaatagaaaaaccttccaagtctacataaacgacttcgtgaaacaggaacattgaagcgaaatggaggaccaggaaggccaatatcagtaagaacgatggaagtagaagagaatgtgctggccatgatagaagatacaggtgcttctactagaaaaattgcaaatattttgaatgaaagtaacaggacgatttggaacattcttagagactatttgttgtacccataccacatacgagttcaggcagtttttcctgcagattttcttccacatatttcattatctcaatccctcaatcaaatctcttagctactgacgtttattatttttaccgatgaagctagtttctctagaaaggccctaaggaatttccacaataactatgtttgggctgaagaaaatccacatgaggtgcttgaagatcgctttcaacatcagttctcgttaaacgtttgggtgggtgacttcataattggaccgttatttccgccaggaagacttaccggcgaggtatacagcaactttttggaacaaacgctaccccagtttctggaggatgtaccattggttacaagaaatgcaatgtggtttatgcacgatggtgcaccagcgcatttttagcatattggctcgagagtttttaacagtaacatacggagatcgctggattggccgaggtggacctcacttatggcctgcttgatcactggacttaaaccccctggagtattacctagagggtcacctaaagtcattagtttatactacaccagtgaaagatttgataaatcggataattgctgggtgtaacgcaatcagaaacgatcctggtgtttttgaaagagttcgggagtcgatgaggaggggtagtcattttcaacagttcttgtagattaagaaacattgcatgtaatttttggttataaattgtaactgtcgctccatatcttcgaaacaagcgccctatcaaaaatcatccacggacaaaatatccttagaaaagtcgaaggaatagtcccttaaattttctccgcacatttaataaacaccctgtagatgaaaagctaaactcattttcttcgatgtttgatttgttgcttccgtgaccttcataactttaatttgtttcaaattacaatgccagtttgatgaaccagattaacgatcaacttcagtgcatatggtgagcttaaaattagtgtttgaatttatcttgctctaatttttcttttgtgctacggtttacctttcctaatagaaattttttcacacctctatgaaactgttcaatactatgcagtgttctaataagtagaagacgatgtttaaacacattttaccattgtggaatacttattgttttttgctattgagagaatagaaattgatactgattcaatgtcttttctgtgcttcttctgcaagaacccaaccgtttgaaaaaaagacatggaattggaattttttcctcaaagctctttcgtggagaataaaaacagaaataactatgttttgagagctcccgccacagaaacatacaccataacaatgatgtgattcacacagggcagagtaagctaatagatatattcaaataatttagtaggttttacagtttagcaacctgtagatatctttttgaatttattgaatcccaaaatttaatttagtgagtacctagagttctcaaaataattttgttacatctacaccaataacaaatttacatagaagtttacaagaatctgaaattaacctttaataaaaacaatctccatattcatgcattcaaagcaaatttctaaaatctgctttttaattatgtgaccacccttcttatataattctttaatttttcctttttcatatcctgcaacctagttattttaacggtagaattttcttccttgcatctcccacaaaattctttcagaatgggatgcaaaggactttgaaagtatatattcttgtttttcaattttttgttgtatttgtgtgaccaagaatgcagaaaaatttcaataactaatgctactaatgccagaattgggtggaataaaatcattgtcggtagaagatatatggctgctgtaatgagttgggactcttgaggatcagctttcagaagcctgatgggtttttttcttctgctgcttttttttcacccatgtaatactctattggta

SEQ ID NO: 137 - DNA, 2868 bp, Leptinotarsa decemlineata
  Annotation=Tyrosine-protein phosphatase non-receptor type 1; Tribolium gene name from OrthoDB database=TC003328; Blast E- value Tribolium Gene vs. Leptinotarsa Unigene=0
gaatcaagagttgtttgagtactgtggagtctttgtttctttttgttgtaatttctatcagttttttgtactttctctttcagaaatggtgatcgtaattcaattttaaattttattaagagttatatgcagcaatattttgtagaacaatgacatctggcaacaatattgagtccgaatttttggaattgagttctaagaatcagtggcaagtgttctatcagcaaattcgggcccaaagttctgttgacaagtgttcagaagcaattaaaccacaaaacaaaattttaaatcgctatagagatgtgagtccatatgatcatagtcgcattatattaaatagaggatcaacagactacatcaatgccaatctaattaaagtagaacaagcaaatcggcaatacatattaactcaaggaccactatctaacacatacagccacttctggttgatggtgtgggagcaggaaacaaaagctatagtaatgttaaataaactagtagaaaaaaagcaagacaagtgctttcaatactggccttccaaaattggtccagactataaaatgaaccttcctgatgtaggcctgtgtgtagaatatatagagcaacaagatcattcttactatctgactagaattcttcgactgactgatactgaaagtggcaaatttcgtgatattcttcagttccattatattacatggcctgattttggagttcctacttctcccacagcttttttagagttccttcgtaaagtaagagatgcagaggtgttggaatcaactgtaggtccagctgttgtacactgttctgcaggaattggtagatctggaacattttgtctggtggattcttgcttgattctcattgaaaagtatggcatcaattccgtagacgttaaagaaattctattggaaatgagaaaatatagaatgggcttgatacagactccggaacaacttagattctcttatcaagcaattattgagggtgctaaacagttaatccataagaacacttctgaagaggataatcttgtaaatattagtaataatgattcctctaatatccctgaacacattactgactctgaagaagatgaacctcccccactaccacccagaaatgagagtcttcccaatggaacacctctcgacagaccactcccaaatattccgaaaagtgtttcagataatgatctgacctatgatgaaaatagtgatatcttgaattacattcccagcggacctttacctgtagtaccagccgatgaggatgagtgcagtgaagaagatgaacttgaagaagaggaagaagaagatttcaaaccagagacagtcagtcctgatctagagaaatcctcattaatagaatctgagaagccagttttaatcgaatcgaaacacagttcatcctacgaggtcagacaaagaaacagggcacagagaaaaggaaccatggagtctcaagtgcgggatatgaaacgccgtcaacaaataaatgaacagtggactcgattgaagaggtctttatacttacctttagttgtaggaggctctctactgttgggcggaggtctcattgcttatatttattacaaagattgagaaaagatcccatctcatttttttgtatttattacttattagtaaggttgttgacaaatatgaaagccagaaacagtgattattgcttttcagatgtgtccatgcgttttgtatgatttgaaaaatctttttggcagcttcctaacaaatgtattttagaaatcgtacaaaacttgagatgaacatgatggggcaaaaaaatcactagttgctcatatatgctttcttgaaagtaagatgactcatttatgggtttttttcgaaaggatgaatgtttttttagtatattttgacataataataatagaacactttgctttgtttcaatataatattgaatatttatttcattaatagaaaatatttgaaaattggtaatggtttcgaaaatatcacaatccatatttaactgcttgctactacactaattatctttttattgaatacctttttgaatcatgtttcattctaagaggaattaaccctgtatcatcttgttcggaagtaaagattacatatttgtgcaacctgaaatttttataatctgttatctattaagttttcacgaaatgtttttggtagcactgaaaaactttatttatgaaaatgtgacttagtaaatgttttcttttgtccaaaagtcttatattacatatcactaattccatacaagagaattataaatatttgttggactttgagaacagaatccattcttaaaaataatttaagattaatttttgtgtgtcgtgggaacaattttacaatcacacttataaagatatttatgaataccaattaataatcatttggttgaaattgaatgcctgaacagatttcttaaataactgtattcccttttttctgaatctttcagtgaaaaagaataaatcacatccaaaaatgaatttattcttctgaaactcacatcaatcataacaccacttattttgttgaaaatagaatcgaactaaaaatctctgggattcagaacaacaaacaacaatagatataacgatatgataattattatcatcgcatggctcaacctaatagtcattaaaatcttattttgagagagttatacagaaaatatattttatatttatttttgtcttcagatgggagtattaaaatgtattctaatcgaattacacattgaaactttttccaataaaatgaatttgataatatatatattttttaaattctgattcaataatatttgattgttaatgatgttgataatgttcatgta

SEQ ID NO: 138 - DNA, 3623 bp, Leptinotarsa decemlineata
  Annotation=Synaptogyrin-1, putative; Tribolium gene name from OrthoDB database=TC005401; Blast E-value Tribolium Gene vs. Leptinotarsa Unigene=1E-93
ttattaataacatatatatccttatacaaataatttatacaagtaaatactgaaaaataaataattttcttttatatataaattcgttgagttacaccaaaaaacaagaaatatgcttggacaaaaaaaaacaattatttcaatacagttccctcaatataaaatggttgattatgacatcatattaaaatactgaaaaaaaaagaaaaattatcagcgagcaacaaatttaaaaaagtattatatttaataatctagagttcttactcaaaatcattctagaaagtatgactgaatccttcaaaggttcattttatgaaaatgaaagtaccattagttacactgaaaaggggttcaatactctttggttagttgaagtgcatatattttgttcaaaggtgtaactcgttgaataatcaatggtaaagctgagagaacaaaataaatatgttagtattcacagtttattattgctaatgctaagactatcaccttgacaaggaacaactcttctaggcaacactctatttcacaccttcaagcagcaatatgaaattaactataaagttgtgctaacagttttaacataatttggtttcaaatatttagactcagaagaaatttccaccattgaaatatttatctttgagtgaatactactggagttttttcccaacaccaaaccgttattttaccacctcgacacgtgcttgggaaaaactccagtaatattcattagtacaccaaaggttccaaacagtgcatcacaagtatcattgagtgagttttattgtctaattcaagtaccagagtaggatgatctcctgatcctgtttttcattattcaacttaatatgacaaatagacatttcgagaccaagagaatattatggcgcctgtagggcaaacaactgtttcaatcataaaagtcaatagttgttttacttatttattgtttactggtttgtgtgtatttcaagaaattacttatattttgaggtatttcattaatacattatatgcatatgttattattggaaaaacgagatattggagtgaagcaggtttgattagtttttccattgttttcttatcacctgcgttcatttacaacttccatgggtatgaaatgaagttgaaacatatgaagctcataattattcaacaactgacttagtgttgaaagctggggagaaaaataaaaatgatttctacttaatggttggacaagtttattgcatgaattcagaattcagtgctaattcaaggtttttcagtagcaaaatcattctaaatggtattcatgtgtcaccagtacagagcagaatggcttatatttattttgatagttttaatcaattcaaaaacggaattgaaaatatcttttttcaagatgacagaaatagcttcaattcctttttcaagtaaatcaaacctgtcaatatgaagtctattccaagtcattctgccatctaatccagtgaagctacttcatttgaaagagagagtaataaatatcttctttgaaatagaattaaccctgttagatcttcactttttatcgcagttaaccacatttctcgtcggtttcttgatactccatgcaatgaattcatgctcttggagacacggtaaaaactcacttggtccttcattctatgatttcaacaacggaccagaatgagttattggtattatgttgaatatactttgtgaagggtaatatagtcactgttacaatctatgtgtgccatgcggacgtcattttggatttatatgactgaatattggaaattctaatatatttattcaattgatattgatgtcttgagaaacttggttaagtttttttagtgatattttatttcaccctgtatttttacatatcttttatccctttcacaataccccttggaagtcttcattcgcagttgttaaagctaagattttatatttatggcacaataaaacttgcatcgggtgataatatataacttagaggtcccaccctggtaaatgtattttaaaataataattttgtttgtagcaaaatacatttttcaataggacaccttatcatgatttatatcgaatgtaagcctagaggtacattaattttcggtttagaaccgaatttggagtagtttgctaaggtcaaacaaatcggataaattcaaagaacatttaccagccccgccaaagattatgcagatacatattatacagattcatttttttttatataaacggtaatcctgggtgcccttttcatcgcattacttcaaaatgttcatctacaaaattcacagtttaataaaaaaaatctcctaaacagatttgcttattaagtagtctataaatccagctaattctacataaataactcagtttgaaaaatattccactattctaatggcacacaaagtaacaagtcagcaacaattatgctatgagtgacattttcataacattatattaaaaaatcctttgcaatacaataacaaatttcaaaaaggatttctacataagctttcatcttgatattcatatacatcaactgtacactgaacttttactaaaaataattatttaatatttctttatatatttataaatcgttcctactcatcatggctgtgtcatttatagttcatgctacaaaatataaagttagcctctcgtaaaatcacaatacggataaaataaaggtttcattactcgggtaagaatttttatttcgaggtggttaatactatcatgtaagaaattcctaagtacatattacaattaccttacatcaggtcgaacagacacgaacgcgttcattcctttatacttgcagaggtagtacctcatcatcagatctggcctttacagctcaatatgccggagcttgaaaatcggtcggtcctcgttggtttggtccagcagaaaatggcggctcttggtaatgttgatctgattctgggccacccggataagatggatatgatgaagttatattaggatcagtttcataatttgtttgaaatgctgcaccaacaccctgacgaaaacgttgaaaagcaaaaaatgcagagccagcccatgaaaatatagagaaaaatgaaaaagcaatggcagcttgaacattatcaacaccgtatccattttcaggggctaccgatttgctccactgatttgtcagataccagaagcccacaaagtataaaaatgaccagaaaactgaaaatcctaaatctcctaaaacaaaatgcttccttgtctttacagatgacatctgctcaaaaaaaaattctccgactaataatcccatagtagcgaggaaagcaataacacttatcgcaactccataattgcaagcattcacatcttcattatacagacaaacttgcttgcctgtcgctttatcatgtttccaaccttgagatgatatacaaccgaagacaattacagagaacagccagcagactccccggagaataacctggggtctttgtacgaaagaaataatatcaaaggccccgccagcctttccgccaccgtacgcaccaccagcaccctccatattttgatatttttctttctaatcttcacagaacttgacggaacagactatgtat

SEQ ID NO: 139 - DNA, 2697 bp, Leptinotarsa decemlineata
  Annotation=CG6695, isoform; Tribolium gene name from OrthoDB database=TC008355; Blast E-value Tribolium Gene vs. Leptinotarsa Unigene=2E-111
gagtgtgaccctgaatttgcactgaataaatttgaccgttttgtggagaatcggttttggatgtcggatctttccaagaaaaaaattacttgttgaacaaattttttatgattgattttggttgattataaataaaagaattgcacctatgagtattatgtggcacgaagctaggaggcaggaaaggaagattcgtggaatgctcgttgattataggagaagagctgaaaggcgacgagatttctatgaaagaattaaagcagatcccacacagttcctgcaggtacatggaaggagatgtaaaattcatcttgatcccagtgttgctgcagctgcggacagtgctgtgatgatgccttggcagggtcaatcagatatccttatcgatcgatttgatgttagggctcacttggattatatttctcctgtcggaaagcaagatgaagaagaacttacccaagaagatagacaaatcaattacgaaagatacagaattattgctcagaattcattcctgggtttgactgaagaaaagtttctcaaacagttacatcttgaggagcagtatgggtatactgagatgaaaacaaggaaagaatcaagaacaggcggagctgccattggatttaattacgaagacgggacaggaaccactgtccctgcaaaccctgatgaagaagaatctgacgaaaacaattctgatagtgaccttgatgtggatcttgcaattaatgtttcaaaaatggagcctgcacaagctcatgaaatgaataagcatggtcgcaactacgggatgagttctaatgatttttattctttcttaactaatgatttagaggaggcagaagctgtgcgattagctagggaagaagaacaggagaaggctttattttctggaagaaaatctaggagagaaagacggtatcacagggaaaaaagacttgcaaatagggttatcagtcctccaagttatgctgctaaagcttccccaactctacctaactttcgtgacagcaaatcaaaatcacattccagatctccatcccctgagaattctggaaaaatcacatacatcacttcttttggagatgacgaagatgttccttcgagtagtaaagaaacatatgcagacaaagttaagtacggtaagccaaaaaccaaaatccagatgaatgagagatcatctcacttagaaaacaagaataaatccagaagcagagaacgatcatatggctcaaaaagaaagagatctagatcagttagtagaagtaaatcaaaatctttgaacagtagatccactactagaaaaagtagaagtagatcaaaatctagaaggagttcaagcaaaagaaggagtagaagcaggtccagagctcgtaggagtttgtcaaggtctaagagaagcagaagctggtctagaaataggaaaagtagaagtagatctaggaccagaagaagcagaagtagatcaaaaattaggcgaaacagaagtagaactaggtcgaatagaagccgaagcaaatcaagttcaagaagtagatccagaaaaagcagaagtagatctagagacaggactggaagatctctaccaagaaacataggaaagtcttttaggagacgtcactcaacatcttcctcttcttcagcttcaagtagaagtcgatcaaggtcacattctgaacaacaaaacaaagatactgtcctgccgataccaaaagaatctcctgaaaaagatttgccaaacgtatcagaatcagtgaaagttataccgagatattacggtagaaagaagagtgatcaaagttcttcagaaatcagtgattcggatgataaaagtgacgttgagatgaaaccggcctctaatccggttagcagtgaatcaaagagtgggcatggtaatagttcaggctccgcaatcaaagtcagtaagaaccaaataaaattgttttccatattatttttttagttaatcctaatttgttttgaatggtatttgaggtaaagggttgtatttttcgaagtatgaatatcaaattgttgtttgagtcgaaaacattttaaattcatgattttcagaaaaattcacgtttgacagtcatagaacgccttaaaaggaaacgacaagctttattgaataaacagttcaaggcagataaaattgctgaacagctcaaaacagagagagaaaaacaggaacaacaaacaagagaggatgaattgcgtgaaatggcaataaagttacgtcgaaggcaaagggaaataaggcatgctaatgatagcagaagttctagttcagattctgattcaagcaacaaaagcaaaaattctgaaaaagaaaaacaaagtctcgtagtacaagccaagacaaagacgattcaagaaaacacaattcatttcgagacaacagagacaagaaagagtacccagatggaaaagacagtagaagtaacaaagatcgcagggatagtaaagaacagaggagcagagaatatagagattcagaaaaagataatttcagaaatcgacgaaattccagggaaactaggagagatagaaaagattgtcattcatcttctccaagaagaggctatagagaaaattggcgaagcgagagagagaaggaaagtgatagaggtagtaggctagttgactattaaaaatggaattgtatcagatgttgatgtatttaatgtaata

SEQ ID NO: 140 - DNA, 3311 bp, Leptinotarsa decemlineata
  Annotation=Protein O-mannosyltransferase 1; Tribolium gene name from OrthoDB database=TC010429; Blast E-value Tribolium Gene vs. Leptinotarsa Unigene=0
aaatatatgttcgatattcatattttggattagtaattatcattgttttttttttatacaacaacccactatacttctgtcatctcacaatatgtactcctatttgcagacattgaagtgccacagattattgtatataaacgacaattaaaattgtcaactagcaattatatcgacagttcgaactgttgattattgttcaaaatgttgactaaccataacatagttttaagctgtaatctacaattttattaactgttgattagccataatagtcagtttaaattgtcaattaaccataattgacaggttaaattgctacctaatcataaaagtaataacgcttcaaatagttcattaaccataatagtttaaactgtagttaggtaagccataatcaccagtttacatcaaataaccataattgtcagttcaaagccataatcaacggtttcgtcagttaaccatcagtctgttgttcaataagtcatactgaacagtttaaacagcctattaaccctgaaaattcaaactgttaatagtggcttattaaacaactgtttaccataataaacaattgaaacagttctaattagtcatttaccataatagacggtttaataagccataatcaacaattggaatatatgtgacaactctcatgggaagtttaacaaacaattcgatatattctatttcttataaacatgttcctatttctccaagagtttggcagtgcaacgttttgactaaaaggatgaaagagttgtaaatattcagaattccacaaatcccaactcaatatttctcatttataaaaatatccggaagacttctaagtactatgcctattattttgattcaacaatgtaactgcattgttttaaaaacaaacaaattggttgaagaaaattccctacacctcacgaataaatcctcaagaaaaatttataaactttccatctgatctctaataaacgacgagttaacttttatggacgataaaatcccagctatccttccacctcagatcaacgatatcgttcgtcgtcagtgcgctagtaccataacttaccacggaaaatttacgaaacacgaacacaatccatcctaaccaaaccatcaacgacaaaacatataacttcttcaggaatttcgaaccgaccacttcattgatgacgacgtacacgtgctccaaagtagcagctagtagcagcgttttgaaagtaaacgcaggcaaatagtggtgcagaaacaatgttctatcgacaaagaagaatggcaagtaatggaagagatatccggttaggaatatttcgcccaatgtttgaaactggttccaagtttgagaatccaggtcaaagcacaatctacgcctgcgcagtagatagaatatcagcagggcggagtacaggaccaagccgaatgttgccgagtaccagatcacaacgtttcccagcaggtggatctgtgcattgctcgtcgaagagacccaatatgcaattccacgtgacatgagaggccattctaggggttccgaactgtacatgtggttctgaacactatcagtgtttgcaaacaacattttgtaatgtagctcaaaaaacttttgccagaaagacagtttggtagccgttgtggggatcatttcagctgttaccagatctcgttcacgttctttttggtcgtcagattttgtgtatcgatgctcctccacattccatacagtatcatcctggacgataatcctatcagctgccacttcgtgctggtggtatccccagtcgggcaactgtcgccccgtgaacttcaaagctgtatcagtatcaacgtgtatcaacctcaccagcgactggattgtatgccagttgtcgccctgttgatctctgttcgttatttcaactctccataagttctgggccggcatcgatatgttgtagtcgatgtagcaggagacttcttggcattgcggtgaaaggggggctgcaacatcgtgggagttcagcgctcgactggagattccatgtacaagctgaatgacatctccatgcttaatagcgtctacaggttgttccacaatcagatcatctttgtcaggccttttaactatccaccaattgttgacgtctttaaaagagtagcatgtgacctgttgttgatgactagatcctcttttgtcagggtatcggatcgggtagagggcattgtgggaatgaagccaacaggttcttccatgtgtatgacgtaaagttatttgagaaccatgagccacctggaggggctgtcctttagtaatactcgccaatcctccctccaaagacgcctgaaatgcactcgtcatgatgctatcgtgcggccccgccttatttaggatgctcagatgaacgtaaaacacacctaaatatactaaaagagcaactgtcaatgcaactgctgattgaatacaaaacctaacgaacaaagccacatctgatattttcggcgaagccaacagtctccagaaatctctcagcagaatagcagctcccagaaaacatgtataaaacccaatatacttgacactcaaagcacacgttagggagacagaagcaagaacaatccatagaaaccaaaaacaagcaaaaaggcctatcagagtatttcttgaacttcacgatgcagaggattccaaacagggaaaagaatattagaactgattccatcaaaatgaacctgctctgagttaggaacgcattgtcaaacaaaaaaagtaagcagccagcaatgaagtccattgcgagagacctacctctagcatcaagtgatatacagtgggaattatgaggctaccgaaaaacgctggaacaaacctcaaagcaaataagggcaaggaggaaggatatggactgcctattttgtcgaatctgaactttccatcgtagcctgctatgtgagctacagcagcaatcagctgtttgccaagaggtgggtgagagtcgaaaaagaaagtattcttcatgtataaagaaacatactttccataatgcaattcgtcaaacactatgtttttaggctcctcaagtttgtacattcttgttatgagtccgcataagaataaaattatagagagaatgtctatctcacagttcactctgaataaattgtgttcaactgtcctctttatttctacttcatttttcagttggggagaatcgttatgtaggttgtcactaaggggcaacgtgtctgatttattgctcactggcgtctcttgagatgattttatcccatctttactatctgctttcagttctacgaatttaggagtaggg

SEQ ID NO: 141 - DNA, 1778 bp, Leptinotarsa decemlineata
  Annotation=sorting nexin; Tribolium gene name from OrthoDB database=TC000739; Blast E-value Tribolium Gene vs. Leptinotarsa Unigene=3E-1; Blast E-value Tribolium Gene vs. Leptinotarsa Unigene=0; Blast E-value Tribolium ...
  ...Gene vs. Leptinotarsa Unigene=0
gagtgtcaactaaggtgacagacgatagaacacttgacaaaaaacagggtagattcttaaattgttggctgttttttgtgaacttcaataaattagttattctgttgtctcagcgtttctacgatatttaaaaataatagcctgaaaatgatggcggagtcagatacaaccgttgaagccacaaaaagattaaatgttaaaaagcaaactttagatgatgcctatgctgctcctgcgaattttttagaaatcgatgtagtgaatcctgttactacaattggagttggaaagaagaggtttacagactatgaagtgagaatgagaacaaacttaccagtgttcaaagtaaaagaatctagtgtgagaaggagatacagtgattttgaatggcttcgaaatgaactggaacgagacagtaaaatcgtggtgcctcctctaccaggtaaagcttggaaaagacagctaccctttagaggtgatgatggaatttttgaagaagatttcatagaagatagaaggaagggtttagaagtattcattaataaaattgctggacatccattggctcaaaatgaaaggtgtctacatatgtttcttcaggaaccccaaattgataagaattatgttcctggaaagatccgcaacacataagaaatggtgaaggtgaagttatagttacgtcctttctactttatattatcagttacccaggtgggttttcaatcaagtgatcaatagctgatcaaaatacatcgttctaacatgaacaattattttagtatttctttcgccttgtaccaatttcaatgtaattgatgacgggcattgcagctaaaggtataacaaatatcctaaaatgtgtatttgattatcacttcaaaattatgtacagcaacataagaaatatcactagaatatgtcaatgacgaacagaaaatattatagattcattcattgtactttgtaaatgcaacttacatctagtattcacaaagtgggacactcttccaaaatttgtatttttcaaaatgtgattttgactgtcataatggagataggtacttctagtcttttaaattgacagtacttttgacagtaatatatataggttgaaatctcactggacaaattatcatgtcacctcaaaattttggttggtgtccatttgtgtatatatattttgtgatatatacctcagtgccttgcatagttactatttttcaaagtgtagatgtggacattgaaaatttttttttggcataatccaaaaccttgtataaaataattcataattttgaccttcaaatattttgatggcttagtgattttggtttagaattttggtaaataacagattttataatgttatggtaatcttgctgttgaataatcatctacactaccattttctcagatgcagataaggttagtaacacctcaacattcaaaaattctcttcatttaaaatacattcaggatcacaatcacaaaaattcatcattgaaagacaatcaaatccatatttaacataatctccatctcctgcatgaaaagcttgtaagcatcgtctttggtacgccctgccagggcattctggtgcatattgaactctttatttcatctctctggcgaaggcgccacagcacaagctgtggcggacccgttagcctggtcattctaggtgcgacttgaggcaacctgagtagtaaccgcggcggctatccgggaggcgtatttacagtctataccattatacagatgagtgctactctataacg

SEQ ID NO: 142 - DNA, 2693 bp, Leptinotarsa decemlineata
  Annotation=Fidipidine; Tribolium gene name from OrthoDB database=TC002495; Blast E-value Tribolium Gene vs. Leptinotarsa Unigene=1E-162
gattgaaaaaagttgtaaggttagagttcagtaatgtcattgttaacaagtgtaatatagtactgcttaaatcgaagttttggttgtacaagtaattttctaattgaaaattgatttcgatttactaccttaccaaattgatgacacaacacatgatatggctacggtgaatccagatgtatttcgaaagtttaaaaacgcaaaaagattacctacaagacaagaaggggacggccacgaaatagaggttgaagttcgagaagatgaagagcagtcggtcaagttacaggagattatcgatattttggtggcagctggatatttcagggccaggatcaaaggtttatccccattcgacaaagttgttggtggcatggtttggtgtatagaatcttgcaatgtggatttggacgttgatttgctttttcaggaaaactcaactattggtcagaaaatagccctcacagaaataattgtagccgtgctgcctaaaatgaaatgcccacatagaatagaaccacatcaaatccagggtctagattttattcacatatttcctgttatacaatggctagtgaaaagatctatggaatttcgtgaagaaatgtcctcttttgtaagatcttatgcagtaaatcagttcgacaaacagtatcacacaaaaaataagaaagaggaaaagcaaaaaaagatgttggagaatttacgaattgttagcgatatctatcgacctcataggtattataaaagaaaaaatgcccctcctcctgacattaattcaagagtacaaattactttgttggaatatgatcacaggggtagagattcacatggtggtattcctggtacttcaacaaacagcgaagggggtataattgaaaataatcagacagaagagaaacagattcaactcctcttgaacagcctgactgctgccagggaggagactctggaatatgatgaattggatgaagaagataaacagaatctcatagaacattatgcatctctacaatctgaattgatggatggaggggtgcaatcaaaagaagaaacaaaaattgctgatttagaacagcaattgaaaatactaaacgaaagatgtaatatattcaaggaaacaagactgaaaatcaaagatgagttggagactactcaaactcttcttagtgagataagactgaaacagcaggaggcagacagagttttgaaggaactggaagccgaagaccatgactctgaaaaaattaaagaagtagaagaattagtaatactcaacgatgatttgaaggctcaagaagttcagtttagagaaaactgtaagcaagaattagttagattacagactttgatagaggaaacaaaaaagacaaaatccaaatctccgacgaaaaacagttcggaaattaacaaagaaataaaagaagaatcagaaaagataaaaacgcttaggttacagcttgcaaagaaaaatagaatagtttctgctctgcaaaggcaacttgatgatgttcctaatagggctgaacttgcccagtaccaaaaaaggttcttggagttgtataatcaagttgcagcgaaacacaaagaaacaaaacaatactacagcttatacaacactctggaagatacccgattatacatgaagaaagaactatcattgttgaactccatatccgacagctaccctgaggcgatgcaatcggcaagtggcaaggaggagttcctgaatcagttccaagccatcgtggatggtgtgcgccagtccagacagaaggttgaactaaagctaaccgaagagaagctcaaacgtgacgaattgagcagtaatttgcaaagtctcgtcgatcagcaaaggaaatacgtggctgcggtacgacagttgagcgttgaatgtaggaagcacgaaactttgctagctcaagccgaaagtagatcttgataggtagggtttctgtgtgagcagaattgtttagttgaactcgttttttgtatggtaactggcgacctggaaatctaccattgtaatcttttgtgagatttgtaatgacctgtccattcaaagttcaccgagcttaatatatttttattatgaggtcattttatggccgacaagtttcctttggaaattgtcaaccccaatattaattatggcatatcctcagtattgtgtggggtggattttttaagtacttggaaaacacttttatggtccatgaaatagaaaagagaatcatcaatgaatgggatttatcaacaaggaagaatatttcatttttgtagactaaccgcacattggcaactttttagtttcggttattaaataatctcttggttcaagcgactttgtgatctgatggatgccgtctattaaagctgatgacactcacctttgataccaacttgaagacgaatgaaagtaagaccttacttatacttgattaataagatttccactatacaaaaccacgtgagagaaaggttatcttagatttcctttaaaccagtggtaatagattatgacacacattatatttgatatatcaatttaaattaagaatgagattgcctcagttgttgaaatccaaatattgtatttattttttctgttatgaaattatatattgttttatgtacatagcttcatcatgagcaaagtttgtaatgtttttatgaataaacacgatgaattt

SEQ ID NO: 143 - DNA, 2663 bp, Leptinotarsa decemlineata
  Annotation=N-terminal kinase-like protein; Tribolium gene name from OrthoDB database=TC008834; Blast E-value Tribolium Gene vs. Leptinotarsa Unigene=0
aaaacagatcagttttattttacaaatcacaccgttctaaatagcttcataaatgtattaaaaatgtatttgaaaaagcatattgatatagataagacttaaaatcgacataatttgaaatgtcataatgttattggttaaaattagtagccatagaattaaaatttcttggatcctaacttcataggccctccagttgttcggctagctctcctagcctccaattccttttgccgcatcaatttcttttcctctctcttcttctttgcttcctctagtttagcgctattagtacctggattttcttcaaggggttcaaactcatgttcttcccaagtggtttgtggattcctatgattgatgtgggaagacaatgaactgttatttgttttagtctctggtggtataatcggagtgatttcgctcgggctccatgcctcagaaggtgaagttaattcagcttctggttcctcatccagactgccccattcttcattttcccaaccatcagttacttttgtggctggtcctgagccagaaggtggacttgttggatcgcttgtgccagtagcacaaccactaccgctactactagccatctgaccaccagtctccatgtctccccagttgtcattatcatcccagtgattgtaatcataatccgaaacagaatcatttcctcggctaccatcttcatgctctaaagatgtcatggaagttacactggaagtcgtcgtggatatactgctgcttgacggctgttctagagaacccggtttgctcaacatccgactagtaacgggattcattgatttgacagtgtctgactgacttctgtaaaatttggcagttactgcggtgacggcccagccagcccaagttgctgcagcattactcagactaggagttgctgtattcacatctgcttccatgctttctctcaagctaggatcttcggatactttttcgagtttacccaaaaagcccttgatggtacggaaaaccgagtctctcacggttttttctgggtccaaagttaattgacagagagagggtaaaatcctcgaggaaacttcagaaagaaggtagtactgctgagttgcagccagagccaatacacctgcatttctagccggtggaaagggatcccgcattgccctaatgaacgctgatatgagcactttttgtcttatctgtggatgcaggtgttgagcgatttttcctaggcaaacggtcgtattagtccttattccaccctggtcgtctttggattgcaatcgtgcaaaatgcctcagcacttccacattcagattattgtaacttaacttaggtgctagatgtatcacagatttgacagtttgttctctgatggtggggtttgtatccatgaacccatgagcaacttgaggaaatatttgatcatttacagtacctgcttgcaaatgtccaatgaaatgctccaactgttggagaagtctagatctggtcgccctgtcattacttccgaataatttgacaacacatggtacaatttttttttggtattctgcagtgtcaagtaatcttccaagcttaaacattggggccaatacagcagagcctgcatcaccatattcaaaagcggttatgagttgaggcaaaattttatgtttgcaaacgttatctggaaaattatctaaatgtggagttaagttagaaaagaaacgatttttttcatttttatctttgatctgaatttcctcaaggaacaataaagtgtcgaccaaatcgttcttgaaatatcctccaagtttacgacatctagatataatatcagcaggattaggtctggaagatggattggaactcactaattcgtaatatagagggcccagttgttttggaattttgtcaatattcttcaaagatgactgttggtacaagggcccattgaaaacttcccatatgaggcatcctaaaccccacatgtcattagaacattttgtgatgattcgttgtttactaggatcattcttttcgggagggctataaacttccaaacttggaatgactttaaagttctgtgctgcatcttgagtggttgacacatattctactccaccaagtttccactcaccagatgaatttacaaaaactgaccagatattgacattattatgacgaagatttccatcattatttaaaaacgataaagctctcgttatctgaaatattccccaagcaacatagagctctttttgaggtctctccaaagtcaaattttgcaaatggtctatcaaaggatctacgtattcagtggatagatacaagactttttctgattctaaactatccaaataggtgagaacactaggatgtctcaaagtttttaatctcttaactgctgccttggctacttctaaatgagtttctgaattattcttcagatcgaatacaaacaccgaaacttcttcactagttaccttctttttgcctttgtgaagagcccaaacacttttatctcctaaactcggtacaagttcaccaatttcgaagttgaagtcttttgatggatcgcgagaaaaaaacgaccacatattggaatttaaataataattaacattattaaatacatttgtctacgaacttttaaaatcctaacctaaacaactaattttgacacc

SEQ ID NO: 144 - DNA, 5159 bp, Leptinotarsa decemlineata
  Annotation=Activated CDC42 kinase 1; Tribolium gene name from OrthoDB database=TC004153; Blast E-value Tribolium Gene vs. Leptinotarsa Unigene=2E-56
agttgtcaatttcaactttttcttttattcattcatttgtattgttgacttgtttctggtgtttttatttgtttggtgtaataattgcatgtgtagcatgactccaaatcgtaaatggatccttttatagttaacagtgacactaaagtaacattaagaatctcgtataataattcaactagagttacttcaccctgaaaaaaagcattgttatattaatctgtatttcctggagactgagaatattgaattggccattctataggcagtgtacatatacaatatgataattttcaattaactctgtcttaatctgataaagttataattttcaagcgaaaatgtctgaaggtttagaatggcttggaaatatattgtcaggagatacagctagggcaatttttggttccaattcgtgatgatcttcagatatctagacttgaacattttgattttgttactccagaagatttagaaaaaattggtctgagtaaaccaggggctcgaagactattagaagctgtcaagaaaaaacgaactcaacaaaagataagaaacttgataaacaagttaataccagtgtcaagtaagacacctgcaaataaaaaaataaatgaagatggtgtagtcattagtgacttcacttcctgcttaattcaggaagccaatattacactgtctgttaaacttggtgatgggagctttggtgttgtaagacggggtgaatggatgaatccgaatggaaaatcaatacctgtagcagtaaagattctcaaagctgacgctattaccgcaccaggagtttttgaagactttataaaagaagtacaagctatgcatgtattgagtcataaaaatttgatcaggttgtatggagttgttctctcccagcccatgatgatggtaacagaattagctcctttaggatccttattagactttttaaggaaacagtgccaacacactccagtgccaatgttgtgtgaatatgctacccaactagctacgggcatggcttatttagagagtaaaaggtttctccacagagatctagcttgcaggaatgttttgttatcagcagttgataagataaaaataggagattttggcctgatgagagctcttcctcaagaagaagactgttacgttatgacagaacacaagaaagttccatttccttggtgtgctccagaatctctgagaagcagacagttcagccatgcttcagacacttggatgtttggagttaccgtttgggaaatgttcacttttggggaggatccatggatgggattgataggttcagaaattctccgccgaattgaaaaggacaatgaacgtcttgccatgccagaagcgtgccctcctgctttttatgcaattcttctacaatgttgggcaaagaatcctcaggatcgtcctactttttcatcactcaaagatttcttcagaaaaaatacaacgccagtgatgaaagtccttggaaaacaagatgatccagataaactgaagatgaatgaaggagatgaggttgctattatagatggtagtcctgaactgtactggtggaaaggacaacaccagaagacttttgaaattggactactacctagatgtcttgtggatccattgagaccaaagcagccagaagatataagcaaaccactccagaattctttcatacacactggccacggttcagcttttggagaatcttggggtagcccgtcttatattgatgatatgtacctgaaaaatcctatggatccacctgacatattgggtgtacaaaaacaaaccaaaccttcacctcaactttgtgataggaggaaaacttctccaaaatctgttttagtgtctggctctctacgaaaaccattagaaaaacaattcaactataaaaaattgaccaatcaagaaagtttcaatactaaacctactagacctccacaaccattattcgacacaaccagggaagaagtacttgtagacatatcaccagaggaaatcccagttttgcgaatgaaagatatacccgataggccagaatcaagaacagtatctctgattgacgaaccaatagaagtttctcaagaaaacgaattttgggacttggatgcccggcaaagttcagaaatggctcctcctccatatcattctccgccttcttactacaattcttcagcttttgcatcttccggtctcctagataatgatccatttgacacatcaactatatataaaatccatggaatttctagtcctaaccgaataaaaaatggatacggagaaaatctgaattttgttcaaagtgatatttcaaataggggactaaatttcatgaacagcaattcagaaaaagattccaaagtagcagtagcagtttccaaatctgttactgttgtgcaaaaagatgtggcagcgcctataaaaacttatgggactgaattggaaactagtatatcactgatgaagttgaaagattcatttaagaagacagttgatgataagttaccaataatgtcaaatgaatctcctgccaagaaaattggggatggaaagtttttggatgatctagagaagaacttcttagggaagaagaatagtgaaattccaaccttggatcctcctccacagctcactagaaatgtgaatcgaaataataaagacaataaggaaactttacaaaaaattcaaaatggtgatcgatatgcaaaatcatctgaattatcagagaagaatgatacaacatctgtgttgaacaaaatttggtttgaaactaccaacaatggtaacttgaagcaaaataacaaaaacattcaatctgacaccaattggggacaaactcagactgaaacctatgttgttaattcagaatttggacaattcaagagtaacagaagatacgaccctgttcactgttcgaacacttcaatttattcaaatcccctctcccacggtgtggaagttgatcaggcaactttcaactattcagctaatggctcccacaatgcagtttcacaaacaatatgtaacaatacttcgtttgtatcatcacttactactacaaatacgttttacaataatgtggctgcttcatacaacacttccaatgggtcgaaaaatagagatagctccaatttgtacagcagccagttatcatcatatggatatggttctattcccggtcggcactacagtgatttagcagaagatagactttatcatgagataccagaaaatcactacagccacgtgcctagtgaagaaaacctgaaaccacacaggccggcaccaactaaacctggaggaatgcagcctttgagtatgcaacaaattcaaagaaaaattcaacaaggacagttgagtgcagatgcagaaagattgatgactccagaataccgtagaaacaaaataagccaagtaagagaatgtgtttctgatgtggacatggatgaatgcctttttgctctccaatcaaatggttgggatgtagcattgactgtaaaatcgttgaaaataaataaattagtcaggctgggcttggctgagaaagagcaatgtgaagccgctttgcaaagaactaattggaatgttgaactagcggcttcagcgatattggatacttgattaggaaatattatgaatatgatatagataaagttatgtttaaataaataaacaagctttcagtgatataaatatcaatatatgtgccaaagataagaaaattgtaaaattagtttctaggttgatgatcataggagtatttttctaaattgaaatatgtgatttcaagtaaattggctagtacgaaggtgaaattagttttttaggtgtgtacatatatgcattatttatggttatctttattatatactttcagtttatgttgaatgtttgaaaattctgtggggacatctgttctttttgatttcaattgtcaagctgtgaggaactatttgttccttaattttgattgtcaagctgtatcaaagtaaataataagttatactcaaatagttaagtaataatttgaaaggaatcccacttagtttttatttcaattattatgactgttattatataaaatttgaacaagaaatcccaataattttccaatttatattataattattataaaaccttttttcaatgattaataaaatgtattcacccaacaataatgatgtatctattgctctatacaaattaaccaaacgtaaattgaacaggaaatgtttttgggaacagtgtcaatattttataaaaatgcaaagacccatacatttttgtattgaaggataacactatatatttaaaaaatacatttttgttcagttcctaacttattacttacttgatttaaggttcttactgatgaaaacctgtatctttatgataataaatttttctggaaatgttctcacccatcggaaacatttcggggatgattatgtggcacttttttatttacataaaacttcctaagacagtagtaaatttggtcacattacttttgtataggaatgaggaataagctttcacggctggcgtcaatgttttgattggattcctggttttgtcttggtcttctttggttgtatcccaaagtttcgactgcaactgcgactgtcatcttcagttgcgtgttcgaggtgctcttcttgacatgtcaactgaaactgaagctctcatttatagtgctgttttttagcgtactttctgtaatggcggtttcgcgcgtactccccacgtggtttggttgacttggcctttttggcgcttttcaatgctgtgtgccagatctttggtagatattttcactcttctatttcacttcacttcactcacatttcactctttctgttgaagttctcttgctgtttgtgtatttatatggcttatggatgcattcttgttgaataattattggattattggacgttgctagcctctcggtattttcgaacaggatcttgtgttccccgtcggacagtgcatgttcagcgactgcagacttctcggtctgtcccaatcggcaactccgcttgtgctcgactaggcgggtaccaatgcttcttttcgttcaaaggagaagaagagaaacaccattgaagatcaactccaaggcactatctgtcataactagaaggtgt

SEQ ID NO: 145 - DNA, 4667 bp, Leptinotarsa decemlineata
  Annotation=CDK-activating kinase assembly factor MAT1, putative; Tribolium gene name from OrthoDB database=TC008799; Blast E-value Tribolium Gene vs. Leptinotarsa Unigene=5E-115
gatgtcatatgttttgcttgaggtcaatcattatttgtcattattgccgccgaaatgaattagaaaggtctataagaaacacaataaattattatttgctgaagtcttttctattgaaacggtcacaatggaggatttcatttgtccgagatgcaggacgtccaaatttcaaaatccttctttgaaaatgatggtgaatgtatgtggacatgggttatgtgaaagttgtgtagatcttctattcttgaaaggtgctggttcttgcccagaatgcagaatacctctacgcagaaacaatttcagaattcagttatttgaagattcaactgtagaaaaagaagtagatataagaaaaagggtgttgcgggattataataaaaaggaggatgactttaactctctcgccgattacaataattaccttgaagaggttgaaaccataatttataatttatcaaatgatatagatgtagccaataccaataagaaaattgaacagtacaaaagggacaacagggagcaaattatgaaaagcaaaggaaaattgggaagagatgaatatgaattggaagagatgttagaaattgagaaacaaatggaggaagaacgaaagaaagagattcttgcgcaagaactagaagctaagaaaaagaaaatacgagagaaagaagctcttatagatgagctcatgttttcgaatgcagatgccaaaaatattgttgatacttttgcacagcaagtacagcaattgaaagaagaagaaatgagaaaacctgtggtgaaggccactcagttttcaacagggatacaatttggaaggcaaccccaaacatcctttttaccagtaccagcagacgatggccctttgtaccattacaaatctactacatttatcactgatggaccaagacctcctagtgatacagacattattgaaaaaggttttcttgataatgttagggctgaaacagaacaggaaagagctggtggttttcagtcaaacatagcttgtaaacgagcattacaagatgccatgatgggactttttcactctaaaaaaccatcttcagtgcactgaatatgagttaatgtaataatagcagtgatacatttatgttgattataaacttatatggattatcaccttaaaaaatctaatttcttcatgtgaagatgcctgatttcacaaactacacataaaatattaataaaaaatagatgaagtctttgaattgcaaaagtatttatcaggagaggaaaaatacaattaaagtagtaaaacattgtttcaattatatatttatgtttcaagctcacattttggatacattccttacttaaatgtacgacaatcaatatacatttctgaaaaatgttaggaaattctcaattagtatttatataagcttaatttatttttaaatgtattaattgacactattcagttattaaaccaaactgcctaacttgaatctggcagtgatgaatatcttggaaaagtaaattgtaagataatttgtgacaagactagatgagatattttccaagtctatcaaataaaattagtacagtatcaacacgttggccgccgtcttggtctatttgacagataaaaaagtctcgctcagcccacagaagacaatttgaccgggaactttctcatgaccagagtgcagcattggtcaatatgactgacagtttatcgcatcttccaagctcagtctgtcgagcttaaagattgcagtagtccagtttttagggttcaatttttatatttgaaaaatactgaagactttccctttaatacatattacttcactaacgaccaccataaacaattaactaacttttgagtgtcaatatctagacaattgttcatacgttctaattaaaatggtgacagcgtacaggtgacacagtactatgtcaaatattgaaatacactggctcggtctatataacaagaaattttttggcaattttagtataaataagtaaattaagaaacacttagcttcttcaggcgtgcctatagtatatagatattgtatagcgaaacacttaatgcgtttttgtaaaactgtttggtgaaaataaagtttcttgaatacgttatggattttcatcaagtatcggccgattccatcacatatataaataaggaagtatgaaaagtgtagatgagacattactgctcttataaaagtatctctgcgcaccttggcccgaggggtaaaatttttgacttgtgtggcgaaacccatattacggcgggcaacgtgttgagtagttttattatttctagttgtgcttgtcaacataagcgataacaaatgatagaataaataaatttattgtaaaaatggagcaaataaggctgacttatgtaaaatatgaaatgataccaggagtatcaaattttaagtattcatcatcagtaacctaaaatcaacaaatttgaggtatttttatggtccataacatatttgcataagtaagcagttatatgatcattcaaattacgtaatgtcttgatatatgtaaatattcataatatagataccagtatgtatatataaacattcaaaataaatacacatgttcttgtataaaactttgtcaaaaaatactaaatattttttagaattcacaaaattagttgagaaaagttgtttacctctctgtaaattgtttttcattccttgagaactttatcatgcatattcatctcatttaccatgatttttttgttctgggtcaagttattgaactcaagatgagctttacacaaaaaatttaatctctgtttgctactaacactagccaccatatttctaaattctacaaaaatataatttatataaaaataaaatcgatattcttgcactgagaaaattttcaaatatgtaagtatatacattaaaaaaaatattcatttgaaatatatactaattatgtgatgcctaaatatttgctaactttgaagtttagataaaaaataatgaaatattggggtcataggaccaaataattgaaagttttctcttgactgttgagtagtaaaccttcaactgagccaattactaaacatacctgcaatgagctgtcatcggataatcaagaaaaataatgttggaaaattgactttctaatgctctatcattaaacaaaaaatgtgagaaacttccaaagaaagtaaaaaaataagtacaataaaactctttatgaagatatgtagatcagcacatacgtttatttcagatactttcataagaacactattacatgaattatttacctttttcccaataagtttttctccaaatattagttcataagaatgaaacagatatcactcataggaaagctacacaacgtaataaaagaaagagttttgataaaatgacaatgttcatatgaaagtaattgtgagggttatttccttgtatctgaaagaaaactttcgccatgctctgcataccttcataaagagtttttattgtagttattttattccttcctttctttggaagttcctcacattcattgtttaaagatgtagaaatagaaattcaaaaagcttttttccccaaaaactaatctttcctaaaaatatttccttctcaataaagcaaaaatatgtcaattaaaacaatataaaccaataaaaaaaaatcacatggatattggtaaaggtatgaattatagattgatttgcattgtaaatgaaagtgcatatcaattgagggacaatacctacataaaaatggaagacaagtggttaaaataactgaaagtaattgatggcacatgcaatgtaactcaataatgcaaacataaaataattaaaatgtatcttaaaaatattattttttctgtgtccttaaaaatcacaaaaattgccctcaagaaaaatgtgatgtataagcctataatcccaaaatataaattaaagcacacagcactttttgttattccttttgatgtagctgggtttcagaggtggtctttcggagagctgaaattttctaacaactcgtaccaattcataaaaagcattgtcgacgttcattctcatctttgcactacattctatataaggtattttaagctgcctagctaattgttgagcttcctcttgccaaactgctctttgatgttcaaggtcaaccttgtttccaaccataagcatgggaaattcatctctgtctttaactctcaaaatttgcctgtgaaacttataaatctcatcaaaacttgatctttctgttacagaaaatactagtagaaatccttcacctgatctcatatactgttctctcattgcactgaattcttcttgaccagcagtatccaaaatatctaatttggctggtatgtcatctattacacattgtttagtataagaatcttcaatagtgggatcataatcagtcacaaaatagctctgtataaattgcaaagttatagcagattttccgacaccacctccacctacgataactaatttgtaagtttggtagttaggagctctatctctatcgttgattttggacattttacataaaaaaaaacaatttctagctgaatttactatttgaaaatcagaaacataaattacacaatgcaattttcaactatacttcgagttacacctactgtctctc

SEQ ID NO: 146 - DNA, 1766 bp, Leptinotarsa decemlineata
  Annotation=Putative uncharacterized protein; Tribolium gene name from OrthoDB database=TC000418; Blast E-value Tribolium Gene vs. Leptinotarsa Unigene=3E-69
agctagttggttattcaacgtctagagttactttttttttttttttttttttctttaaaaagtaacaattttattgcacctatatacaggactgcatttatatacattattgcacttatatacattattgcgcttatatacaatattgctatacaatcatggtatctgatttgaaaacaaaatggtttaatacagaaggtaactaatgacttgctatctatagatttcggagttttgtgcaaagatggctgaatctaaaatactaatacaagagatgttgatgattaatccactcaagttattcgcatctagatagtccagatacatgggtattatttagaatggcggtaatttgatatgcatatacacgcgagtttctaataaattatattttaatactgaataataatttatttaaactggatcaattttctctgatgttataacaagcactaaattatattgactagtattgagaacgactttcacatcgtctcaaagctactttttttttcggaaaattgttcgatagcaacattggagattcatgaatgctttaatattctgcaattcaactgacggcattacattcaagaatgatttgactcaatatgagtcataaggtttgtccgaaaaaaccaaattcgttttccaggaaccaacttttgaacagcaaaacagtcaaattcgaaaacaccatgggaacgaattatatgtttttcggccagccgagaggaaaattacatttacgaaattactcaattatttattttgtctaggaaagcgtttttcaaaatcaattaaatataaaatatcagaacgcaacttccggataaatcggaaggagtcgcctagtttattttttaaaaatcacaatcaggtgatatatcatggcgtaaatattaaaacctagagtcaaatatttacaagcgaactaaaattgccatcttctttaacgaaagacggaagtaataatagtttgaaaatcagtctcattaaggaaggccgccccgaaggccagacccgaagtccattgaccgtgttcgatggccaattagacggagtaaagttaataaacgtagatctgcttgagttggggtttcaactccgctggaatggtgtaaacttcttgagggggcttccttttgacgagacgtctccatttgcctccaaggttcttccggaaaccgcggacgaaacctggacgctctgttggcagattttgtacaagtgtatcctggttgttgttgtacaggaactgagaggtagggggtggtggttgcgtccagagaatttgtcctcggtaagttagatccgtttgaagagcctggggaggagagctttggtggttgttgatctgagcggtgggtgtagtctgcaaaaccacatcagtcacggggtgaacactgttgctgtgttcttccctcttcctcagtttgctgcgaacaagacggattgcaatcattgtgccgttactgcccaccattttcgaatcggggctccgtgatgaaaaattaaagatagctattttgaggccggtttttcgacagttttggcgctataattcactttattaatcacagtttgtagcagcacactaagcacaagcacactgaataaataatcctttggttaagagttcgtgacgaatcacttcactggaaaattcaattgactagaatgaaaattcagatcgagggcctagctttaaactagccaaacaacctctaaaacttttcagactacttcgagtcttgcgttgaata

SEQ ID NO: 147 - DNA, 3500 bp, Leptinotarsa decemlineata
  Annotation=Protein retinal degeneration B; Tribolium gene name from OrthoDB database=TC003397; Blast E-value Tribolium Gene vs. Leptinotarsa Unigene=0
attgacagttcaatcgtcctaatattttaaaaacttatttaatttgtctctaaaagaattattatattatagtttataaagtattcccgttcagtgtttgaagatatcggaacataaagtgtcaaatgaacggaaatgaggaggatttggagttggtttttacttacatagccgaagaggaaagtcctcgtcagccatgctcatcaaagaatatcgtattcctctacccctcacggtagaggaatacagaatagcgcagctctacatgattgcaaaaaagagtcgggaagagagcagtggagctggtagcggtgttgaaatattgatcaacgaaccttacactgatgggcctggcggacaaggacaatataccaggaaaatatatcatgtaggcagccatttaccaggatggataaaaggcattttgccaaagacggccctgatggtggaagaggaagcctggaatgcgtacccgtacacgaagaccagatacacttgtccgttcgtagagaaattttcactggaaatagagacttattactaccccgataatggccaccaggaaaatgtttttcacttgtccggcggtgatctgagaaacagaattgtagatgtgatagatgtggtgaaagaccaactgtacggagcagattacgtaaaagaagaggatcctttgtattatgtctccgagaaatcaggcagaggtcctttgaccacgaattggctggaggaatactgggacgaagtgtgcggcaaacaacagcctctgcccaacggaaaatcgttgatgtgcgcttataagctctgcagggtggagtttcgatattgggggatgcagaccaaaattgaacgattcatccacgacacagctctcagaaagacaatggttagagctcataggcaagcttgggcgtggcaggacgaatggcatggtctaacgatggaagacatcagagagatcgaaaggcagacgcagttggcactgaagagaaaaatgggacatgtagaggatgaaatagacgaagatgacaacttgaacaatagcacttctaaagaagatccttgtaaaacgttggctgctactctaggaagcatagaagtagctgaagatagtccgttgatgagtaaaaacgttaacattcccacaatacatactgctgctagttcggatgccgatctgtctccagaagatgaggttataacggttaaaagagaacacgacaaatggcaaccatcgagaactctccactcgcccagttcctcatcgataaaaagtttcgatctgcaagtggccaattggcgaatcgaaagtttaggaagagactcagagtctgcatctgacgaggagtttttcgactgcgaagatatggcagattcttccttggccaaatggagttcgatggatcttctcaacgaggaggacggcgacacaaactcgccttccgtagtcgatacgaatgatgacagtattttctcggcttcatttttgcaacgagtggcgagcgagagaggcgctagacgacacatgcagagaggcaaaatgaactcgcttgatgcttcttgtccagagtctccgattgctttgcctggacatctcccatgcaacactacagtattgatattgatatttcatgctggtagcgtgctggatgccaacgtagacatggccgcaaaaaaatcagacgtgagcactttccggggtgctttcgaatccgtcatgcgtcaacactacccctcgttgataggtcacattgcaataaggttggtgtcttgtccttccatttgtacggaaggtttgggtatattgtccagtctcagtccgtacagtttcgatgtatctccctcgtgtacagacgtcccgcaaataacgcacgactccattccgatcggtgctattcctatattggcttcgtcatctacggattacgttgaggctgtgtcgcggacaatcaacgcagctaatgctgcctaccaagaattcatcaagtctgaagagggcctgggcttttccggccaagtttgtgtcatggccgattccatcggttcgatattggcatatgattctttgtgtaggacggtgaaatactcttccaggcacggtagcgagaacagtattctggacagcgatctacagaaagatgacatacagataaacgaaagtggttatttagctgctccctctccgagacgcaggtcgtcttccacaagcgatcaggctgggcagataaagttggagtttgacgttacggacttcttcatgttcggaagccctctggccctggtgctggcttatagaaaaatatcctctaacgatgataaatgtaatagtattacccgtccagcatgtcttcaggtgtataacatgtttcacccgactgatccagtggctgccagactggaacctcttctgtcagcgagattctcaattcttcccccggttaatataccgagatacgccaaatatccgttgggcaacggacaaccgtaccatttacttgaaattctccaaactaatcctcaaatgtttagtgattccttgcaacctagacgtttatcagaggtgtctattcagagcacgatatcgggactgatagataatataccccttcaagctataaatgctttacaacaaaaatggtggggaggcaaacgaatggattatgctctctattgccccgaaggcttgtccaacttccctacaaatgctctgcctcatttattccacgccagctattgggagagcagcgatgtgatagcctttgtgttgagacaactaggcggtatcgaagttacatccttgcccggagataatgatcgtgagcagattttcaaacccggtcaacccagagaaaaatggatcagaaaaagaacctccgtcaagctgaaaaatgtaacagcaaaccatagagcgaatgacgtcatcgtgcgagaaggcgctcctcaaacgctgatggcccggttcatgtacggtcctttagatatgatcacgttaacaggtgaaaaggtcgatattcacgtcatgaaagatgctcctctgggagaatggacgcacttagctacggaagtcactgataaaacgggacgaatcacttacaccattccaaatgacaaatcgcttggatacgggttgtatcctataaaaatggtggtgaggggggatcatacttcagtggatttttttctagttgtcgttcctcctaagactgagtgcatcgttttcagcatcgacggatcctttacggctagtatgtcggtgactggtcgagatcccaaggtcagagctggcgctgttgatgtcgtgaggcattggcaagagctgggttatctgataatttacatcaccggaaggcctgacatgcaacatcgaagggtcgtttcgtggctatctcagcataatttcccccatggcttgatttctttcgcagacggcctttctacggatcctctcggccacaaggctgcttatttgaacaacttgatcgataatcacggcgtagtga

SEQ ID NO: 148 - DNA, 871 bp, Leptinotarsa decemlineata
  Annotation=Putative uncharacterized protein; Tribolium gene name from OrthoDB database=TC009203; Blast E-value Tribolium Gene vs. Leptinotarsa Unigene=3E-46
cgtgtctctaagcgaagttctccttgttgtgactgggaaatacttttctagcactgattaggtgtttcgatgtttttttttcagtcagcgtgaggtatttttcaagaactgaaggatatgctgttgatttttgggaagagtaacacgccttgctggcttcatgattcgctagcttctttgtggggattgggtatttgtggagaagtccctctaacttttcggcacactcttccaaggtttgtgttatttctacagtgtttggtttaacatccaactcaaccggagttaaatttcctaaaaagttgagcatatcttcagcctgttggacatccttttccaacaatatgagtttcttctgtaacaaaaactcccgttcttcattttctttaatttttgccttcagtttttccatagtgatacatttcaacttgattttttggtacaaatcatgatccaacgttttcttttcatctaataagaactgctttgttttcgatttatcttctagagatgattttttcaaatacaaatctatttcttttacaggaaaggtaaagtccccctgtttatccaaaggtttactattaagcctatgtataaggatattgtttcgaatatcagcaacttgttgtctcggtttggcgttctctaataattggtcccatataaaggaagtggagttattagacaaatttcccaaagtttctggaatctcaccgtcgtaacccattttcctcaaccagtttatgatttctaaatttcgttccataattttaactgaataagttatttttaaagaatttaacaatatttccgaacagtattttttttattttgtctttacaatttcagttatattttaggttaaggc

SEQ ID NO: 149 - DNA, 976 bp, Leptinotarsa decemlineata
  Annotation=Chronic lymphocytic leukemia deletion region gene 6 protein-like protein; Tribolium gene name from OrthoDB database= TC012993; Blast E-value Tribolium Gene vs. Leptinotarsa Unigene= 2E-1; Blast E-value ...
  ...Tribolium Gene vs. Leptinotarsa Unigene=07
tttttctaactgtatcatttaattagattagttttgttcttcattgataacgtggcataatttattacaatgagaactgaatgttatcaggatggatggactaggatggaatatttgcagtatttacatatattcattagtattatacatttatacaaaactttgatcgtgtaaaataagcatttcaaagaataattgaaaaagtattaataaatagaagtttgccttaattctacataaaatatcaaaaataaaataaatacatcgattttgttcaattatcagccttaaaataatactattctatagcagtgattgttcgagcatgattttatcaaatcctgaaggtggagaatgtttgaagttatctaaaattatgtccaatattgctccgtcatccacatatagtgcaggataaacggttccttttacattactgatggattgttcaatttccttcccattcaagaaaaatttcagttggatatggtcaaatgcaaccccaattatatcaccttcctgtatggtctgcatcccattattatcagaattattacagatgtttattttatgaagttcttgtttattatgtcggataatatgatcatgacctaacacccatgaaaattcatccatcccacctaatgaaagactcaggtcagtttgtcttgtagcaataccaatggaccatgaaccgctttgttgaattttgacctcaaaatatgattttgactgaaccaaaggagcgtttcctaatgctgcgccagtaccacatactctctgacccccttttacaataaccacctcatatcccataaaagctgtatccagttgaataggattttctttgggaaccaggggaacagttgggctaaaactaaagttatctaaacaacttctaaaacaacaaaataccgaaacggatgacatgttaattttgtatattctttctttttcaacataacctaaaattctc

SEQ ID NO: 150 - DNA, 1234 bp, Leptinotarsa decemlineata
  Annotation=Spindle B; Tribolium gene name from OrthoDB database= TC013529; Blast E-value Tribolium Gene vs. Leptinotarsa Unigene= 6E-73
gacaattctcgaaatatgtattgagaaaacctgaaaaaaatttgttttgaattattattcattgaaacttacagattttctccacgctttatcgaaaaataaaaacgccagtctaaaaatgactaccgtagaaatatgtgacagcttctgcatagttttttaaacaagtttttcaaaattaatattttgttatgatctacattattcgaagatttctagagaaatggaagacataaaatcccttgttgaccctagaattttagcaaaatcagtagatgacattaattacccttttccatactcataaatgacactagtcaaatggaaaagaagacaggtttgacactaaagaaaatagaggaagtcaaaatgaaagtagccagttatgttttgatttcaaaattcattactacagcagatgaaattcttccatggaagagaataagtacaggatgtaaagcaatagactctacactaacaggaggtattccaataaatggaataactgaaatatttggatgtagtggagttggtaaaactcagttttgtcttcaactatgcttgcaagtacaattacttgccgcagatggaaaagaaaaaggagccatctatatttgcacagaagatcctttcccatcaaaacgatttcaccagctctctacaaggttcaaagaaaaacacaacgtaataaccgattttgaaaaaaacgtttatatcaaccatgtggctgattttgaacagttacgtagatgtctgtatgttcacgcacctaatttacttcaaacgaaagatattggactcataattattgattcaattgctggagcatttcgtagtgaaaatgttgacgttaactatacaagtcgaggacgtgagttatgcgaaatagcttgcaaactgaacaatctttctgacaagtaccaggttgccgtcgtttgcattaatcaggtcacagaagatgtgcagcaaggaaagactgaaccgtgtttaggtttagcatggagcaataacgtaaattaccgttgtcaaatatcaaggtttaatgatagacctactagagaatttgaagttatttttggtcctgatttgccctgcaggaaatgcactttcgaaataagagaggatgggttatttctctggaagattgataatgcatttaaactatagtatgaaataagagaagatgggttatattccctggaagattgataatgcattaaactgtagtatgtaa

SEQ ID NO: 151 - DNA, 5260 bp, Leptinotarsa decemlineata
  Annotation=Transmembrane channel-like protein 7; Tribolium gene name from OrthoDB database=TC003849; Blast E-value Tribolium Gene vs. Leptinotarsa Unigene=3E-178
gaaatgtcaattaaaggtgattcattcaactgctaatggtcgtattcactgttttataaattcattgcatttcattagggaattgaataaaaatgtctgggggtccgaacagaaaaaagaccacccgttcacagggttgggaagaagctggctctgaattttaccaggaaagttatcctgtcgacgccgagattgaagttttacagagagatcccagaaaactagcaactcttctccctagcaaacaaacaagagctgccgctgctactattcgcattcgaaccaatgacttccgaactaataatagaactgtaaggaggcacactggttcaagatctcgaagagaatccacagtacatcgcagaacatctgtagcaggtgatgtgcaagtatcaatgttgccagacttgtctgagatgaggactaacgaagaaacatcttgggaggaaataatgcaaatcaaagccatgcccatacctatgtctcaaaaaaaggaaatgaagataagaattcttaatgagccgaaccttcgacttcaaggatatgaacaattcaagtggaaacgtcggaaaatatggggccaatttgaatctcgtatgagagaattcttccaaaaaacaggtctgtggaagggttctatgaagcacatagagggaaattttggcacaggtgttgtggcgtttttttgtttttaaaatggctctttattttaaatttgtcaatttttattttcatttttttgtttataactctacctaccattttgcttgattatgacaaatgcaaaaacaatccaaatacaagttattgttgttcagatgatcatctcaatgaaactgtgtctgaaaacaacatattggtcgatttagttcaaggtactggttttttagaatgtacaatattattttatgggttttacggcaacgaaactgttacatatatgtctggtcaaactcctatgtactataatattcctcttgcttatatttttattattccaatatgttttatgatttctatgattgctattataaggtctgctgcaaaagggtttaaggaacgccttattgaaggagaaggtcagttttatcactactgcaatttaatatttggcggatgggattactgtatagataatgaaaaatccgctaagatgaagcacaaagctatatatagcgaaataaaggcgagtctagaaactgaaaagatgaaagaagagaagctaagtcgtactacacaggaatggtacaaaatctacttttgcagaatagtggtgaatagtgtagttgttgcagttttagctggttgtggatgtcttgtttatatactttttgaagaatcgaccgcacaactgaacaatcagactgatctttccaaatttgagcaactcttctttcagtttttgccctcattgtctattgtcagtttaaatatggtaataccagttttatttaaattcctgattagttttgagaagtatacccctccagctgaaattaagtattctcttataagaactgtttttattcgtcttgcatctctagtggtactttatgcttctctctggagagaagttgggtgcaaaaattgtaaagtgtgttgggaaagttttgttggtcaacagatttacaaattgctgttaactgactttgctgttcatgtttttctaacactaatagtaaattttatacgatctctgcttgcaaagcatatagaaaataaaatggtgaaatttttttgtgaacaaacctttgacttgccaagacatgctttagacattgtctacacccagactctttgttggtttggaatattttttgctccattgttgtctttattggcagcaatgatttttttcatcctattttatattaaaaaatttgcatgtgttgtcaactgtaaaccaaacaatgtaatttatcgtgcatcaaaaaccaattccatgtttatgtttgttctattggtctcttgcatttttgttatatttcctttagcttatgtttctttcaaactggaaccatctaggaattgtggccccttccgggaccaaaccttcgtatgggatttagtaggaaatcttttttcatatacaccaatgtggattcaaagcatattttatttcttcagcaccgccggttttggctttctttgctttatagtgattgtattaattctattttactatagagtagtaaattcagcgaatcggcatcttgtagaagttttaaaaaatcagcttgttcttgaaggtcatgataagcaatttttgcttgatcggttaagcttgtttataaaacaagagagtcaaaagagaacgaggtctgagcaaaatagagagggtgatataaacacttgaaagctttgtgtataataaaataacttgtgagttaatatagacttaagaaaatattccttcatatctcgatagtgtttagattgattttttgaaatgtgaacattgcttcacattaaacaaaataactttgtgtcaaatatccaattttcagctgcaaagtggtgtatttttttaaacataatttaaatttaccaaaagtatctagatagcaatcttctgtgattttgattttttgttgtgatagtttaaacccccattatctcctgttttaatcaacatctatttattacttaatctttaataattttagatattatcaaatgcaatatataatgattaatttgattcattttaatgaatgattgtgagcagttgtactattaacatttttacaacttttaaaactttttacaacataatattcactataaattgattcatatgactaataatttctgtatgaattaaaataattgttgataattttaatttggcgcctcttcaaacaacatgacagataattctttattggtaacataataacgataataatttttcactggtgctaatataatacaagtgttaacacatgtcaaaaatggaaaaaataataagatacatgtataaataacattaggtattacaattcatgaatgtgaaatcagaaggtttcctgactaaagtattttcaaagatataccgaattgtaaacaaaacaggtgcaaatcctctcttaagtaaaaactacaagtacacaccgaacagactagtcattaaaatacgtattttattatttagtttcattagtatttcagaacagtggatataacatttttttataggttgttcgttgtagcaaaaaaagagaaataatatatgtgcactagaaaacttgtagttatttttaaattatagtacaataaattattgaatattggtgaaaatattgaaacaatataaagaaatgaaaatttgagaacataatgtttaaacatttctttcactacaatcgatatcaatatctgaatcctaatcactgtcagtgaaatcagttattgttggatctattatggtagcaaaatgatcacgtgaaattatttttctaccttttcttttgtgatattttcactatctgcttgtataaagataattactgtacttgtcaagttttaatattttcagagcatagtcttgaatcaagtttgtgcgaaagaaattcgattgcaaaacaaatattgaaatttcaactctcagtttttaaacttgaaaccccaggaactcttgacaattattgattatagtgagaattattatccataactatgtgagttcagtgatgaatttttatttttttgaagctaataagcaattttaattccatccacaagtaattaatttcccttattaaaacactttgaatcattggttcaacttgttttcaaagtgttatgagttccaaatcatttttcttacacatatatttcaattataatgactaacatctaatagcaatcaaatattcagaatgcataatctgcctgcatcttgattatacgagagttttcaatatattgattgctgttggctgtatttgatattgcattcatcttgcactaaatgtttatttgaagattttaatgaagcattggaaaatgtcagtgctagtaactgtaattgtagataattaaaaacgcatttaccatcatcactgtacttcaagcctaatgagatcctgatagtttaagtccaagtttgtcttttcatactaaagaggggtgcagtatatggagtgtgtcgatgagagactgcaataaatcagtcatatatttatttactttttactcctacaaacacaatattgaattgtaattaaaagtaagagagataaaactacaataacaaaataagcttaagaactactaactaaaataaaacaaaacagtaaatataaaaggaaacaaaaaagaaatcaaataaattatcacaatttttaaaatgtatacaagtacctataaattaagttacccaatacctagaatatatgatagaatttgagtcatcaactgtttgttaagtgtgttaagagtttctgtcagaatggtcatagtcacattcagattatagtgaagaaacaggttggtcatttatgaatatgtatatatttatctcaggagccctgagatacaccataaatagaagatctggaatttggtgagctgtttttgatcttcacagattgaaatcagttcgttgaatatgattggatcatttatatacattccttgtaaaaattatatgagcacgagtgcacttgttttcaaaccagcagattctctcaatttattgatagtgtgtgtgtgtcgaaatacgccaagttgaatgccaaactatacctgcatgacatattcaatgtttttcttaaatttgattgaatgaatattgaaaatatttccaaagaatagtaagattgcaagtggtcaaaaatatgaagttttcaatgtatagttttttagcaatgtaaatggcaagaactattttgaaaatgttaggaagcacactctcacaaatgatacgtttataagttaactgtcagtttagttggtaagtggatttagagattttgttttttgtgtggaagttctgatattgtcaattacaagtaagcatgagtactcttttctccacactcatatagatatgctgcagattctggtcaaatgatatccatactagtgaacgggttatacagagtgtcagtttataaaaatatgccaaaaggtcaatgccaaattaaaattgttaacaaaaaatgtaattcttttatcaacagaaaaagtattcaattcactacagactagtaataaaagttagacatccaatgagataatatgaactctgttccat

SEQ ID NO: 152 - DNA, 2591 bp, Leptinotarsa decemlineata
  Annotation=N-acetylgalactosaminyltransferase; Tribolium gene name from OrthoDB database=TC007223; Blast E-value Tribolium Gene vs. Leptinotarsa Unigene=2E-14; Blast E-value Tribolium Gene vs. Leptinotarsa Unigene=0
tagatactgagacctggaacgtgagtcaattcggttgaggaggaatattttgaaagttatatttcctgaggtgttctggtgcctattctaaagatatttaccaggttttgtactaatcaatgaccacacaacgttcaaaaagtgttttgatagttcatcatatggaaaaagacaaaaagagacagtgaatcactgagtttgatacatatatatattaaaaattcaacatcttttcaaaacaatgatggttgttaaacttttaactataaatcacaactttgatggatcgtaattttccaatgaccacctttgtatttgggagtcaccattacatttttccattaatagtttatttttcaaattgttgatagctaaacattttccgctactgccatgacgaagcactttcagctcactatcatactcccaaaattgattgcctttacttccatgacacggatataggataacttcttgtccactgtaatccaaacatgcttcatccctgcggatttccccagctttgctgtacatccagaactgattgccaccctggcgatgacatggatacaatcccactggtttatgcatatcgctttttctagctgccgaatctagacaagtttttccaccatatccaaagtttcgtacctctccactggctactgcttctccaggaataaataattctggataaatagtatccaaataccatttaaaactcttgcactgcaatttatttctcaattcttttcttttactaacatcaccgtagtcatctttttcatttcctattcgttgatagtaatattttgcatattcatccaaccacacttctgctagacgtacagaatttcgtcttagaacattaacaccagttctccatttataaggtgaacgcttcctgaaaatgtgacctacatgggaacagggaacaatttcaagtgtgccaccacacatccaagtcttaaaagaaagctccagattttctccaccccagatgtcaaaaccttcatcataggtccctaatttctcaaaaaacatcttgtctatactgaacaatcctccagccattgtcggactccacactggttcagcagaatttttgtgcctttttttttcatgttcgggtacagcgtgccagttaaattgtaagttccaatcaaatccacctacatttacaccactgctgtcatgatagtggaactccatggttgtgtcatctataacgtcgatgacgggacatacaacagtagtactgttgcgagctatcctatccagaagaggttccagccatccagcagcgcactcacagtgggagtcaagataggtgagaacttcgccagttgcatgagctgccccaagcagtcgagctcttattaatccttctctctttttagccctgataattttcacttttggttctttcatccaatattcttccaattgctctttggtatgaggcatatctgaaaaatcatccactagaagaacttctttgatgagatgttcgggagatctatctagcaccgagtgaactgttctaagtaagactgaccatgcttcgttgtggaaacaaataatcacagaagttgaaggtaagttttcgaagtaaagccctggagttttacaccattcatctctaggatctggtaaactacgacggacgcttatcatgtcacttgcatattgattaaaggcgtttttcaaccatccttcatcaactaacttcttgatatctcctgataaattagcagggagaatgaccggttttcccatttctccagccatatcttgaggaggaagcaatacacctccactatcatcctgtcttttcactggaaattctgaactacgtgtccatttttcaaaagggttcaccctgtttggttcaacttcgacttgttccttagtttttttcactatttcaccatttaaccgcatagctacactatttggagtttgaacactgttatcggtatataaaagaaatgctatggtaaaccaagctgtaccaattatcaccaccagctttaaaagaagtgacctttttcgccaaagatatcccataactaaatagtaaactacatacaaccgcgttgactaggaaaataactgatttgagtcttatctaaatttcaaaatcaacatcacgataaggttcccgtctgattacaactgatatcacaaatgttctgtacattcctcatcgtttcgatatgtgtcgatgtattgctatcaatgtggactacgtgaatgcttttctagagatgttcattcctcatcttaatacttcctgtttcctgtgagcaaatatctactataagtaacaagaataatcccaacaatcaaaacttcaattcaaacacctgaatgacctttctgatctcgaaatctatgaactattatcgaaaattataacactctaattggaaaaacaatcataaatcactggagtctgaagaacacaacattcacgcgcacaaccttccgatgacaaaatcgctaaataactgtacattaacacagctgagccaatactactgaaacattaaagacgactctactcatcgcgcatcgctatgtattcc

SEQ ID NO: 153 - DNA, 5667 bp, Leptinotarsa decemlineata
  Annotation=Breast carcinoma-amplified sequence 3; Tribolium gene name from OrthoDB database=TC007705; Blast E-value Tribolium Gene vs. Leptinotarsa Unigene=0
tgttgtgtaaattataagtgaatgtatttttcgcgtaaactggctttcctctgtaaatatattgattaaaatataatcaggggaagttaacattttagaaaaacaatcgaccagacctctgcaagttgccacagtacagttcgttgcgaattatttcaaaatgacgtcaatcactggtcggtagagaaatgacgcagttttgtgttggaaaggattaaaatgcaaattttccattgaaaatcataaaaaaaatcccgttaattatgtccgattcaccaaaccattcgaggtctcggtcgaactcagggctcaacattgtaacgccccatcacgttacggatcataccattctagacagcgttgctggattcattaacgaagtagtcccgacggcaaacactggactcgtcgataccaaagatcagatccaatgggctagcttcgagcatttcgactcaaaaggtatctttttggacaagacttacgaaactgagaaagttgggtctcctgctgtgatattggctctgggatacactacaggtgtacaggtgtgggctataccctccaatggtgaggcaactgaaattttaggttggcgacatggttacgtaaggctgttgagatttatagtaacgccatctgttagtgatttgaataagcgagacgtttttgcctcgaagcggcccttagtagccatttgtgaatgcatgacaacggattctccgtacaattcactcaatttcatgtctttgaagactggagatcaggtgaaagccataaaatttggcagccctattttggatgtattttccaacagcaggtctgttgtagtgacttttcatgaaaaagttgctgtgtttgatgcctttaccttagaagaccgactcatcgtgaccagctgctacataagcccaggattacaaccgaatccagtggcgctcggagcaaggtggttggcttatgcggaaaagcgcttgaatccctccaagaagagcaatggaggaaacgacggagaaggggttcagagctacactgccaccgtactccatgcagccaagtctttgggaaaagggctcagagaatttggcgagagttttgccagtagtctagcagggaccccctctttgaaactcagtacgagtcctaacagtccacaagcagggggtcaaaacgattttgctcataagggagttgtcacaatcctggatattgaaagcccctttgtgcatttcctggagaaaaacgctccggccagcgaccctgttatagcccactttgctgcgcatacggaagccatagtatatcttaaattcgacccgagtggcatgctcatcttcacagcggacaagcgcggccacgatttccacctgtttcggatacagccgcatccaggagggccggctctagccgctgtccatcatttgtacatactgcaccgcggagatacgacggccagggtgcaggacatgtgcttctcgcccgattccagatgggcgagtgtctcaacgcttcgagggacaactcacgtatttccgatcacgccgtacggcggcaacgttggggtgagaacgcacacaacttcgcacgtggtcaataagatgtcaaggtatcacaggtccgcaggactgactgtcgaaggcaggtccaacagccctgttgcaatgtttgaagcaccttcgagctccccttacccgtatctgaatccaaggtacccaccctacccacgtcctacagtggtgaaccccttggcccaaatcaggcaacctgtgtacattcagaatccaaaatcgtctcctcaaaggccgcagacagggcgacaacggctgtcttcttcgtcggaagagaacgtttcactcggcctagtggcgtgtttcgctcctccaagagcttggttagacacacaatctcgcgaaattgccgcggccaacaagcagagaccagtcgagtctctgttcgtgatgtcgtgttccggaatgctcatccagtatgaacttgacccgcaccaagtctccaaagttcccaaggaacgggtctcaagcgaaacgcctatcgaactgactgtttgggccaaagcgcagtggtttctgcaaaggaagccctcgtccgcagaactgcctctacccatgacaaaagacagtttaagtttcctggatcaagaagagcctgtacgtaaaaagaagtccgacgacaatgacgaactctgggtgtcccaggtggaaatcataacgcatgccgggccacacaggaggctgtggatggggccgcagtttactttcaagacaataactacaggatcacctttctctttatcagaggctcaacctgttgatctcagtcattcgaaacctatgaacatgcctattaccaaagcaaacgccgtattgatagaatcaacgtcggcgtctagttgcgagcaatcactactggaaacatatcataggacgttggaggaagagggtggggttggagagtctaagctcaaagaagatctagcagatgccatgttggaaccgacgggaatcagagaaaccggagaagaagaactcagctcaagcagtttcagttccacgagccgtgcctcaccaacgccctcttatggtgaggcttttctgcattttcctggggattccagtagttccatatagaattttttcaagtaacgctagttactatgggtaagttggatgcgaacggttcatgggtatgaaattgtcacaagtagatgctctttctataactttcaacctttaatatattgcagataaatattagctcaaagggttatgacgatgaaatgcaaaactgatgtttacgatttctgtgaaagctatcaatatattttgggacaagaagtcaggcatggcttatcagattctacttttagaatatggaaagccattggtaatgatttcatctattatataactcatgtttgtaactagaaagattaggacatggggcaacaaaaaaaagatactggatcccatagaaagactgaagaacagaaataggacgctttcagtgaagacggacttttttcaattttttacatatcacatatgtttctaattttgaaagctgccctcgtcctactttcgacaactcctaattgtgttacaattatgttttaaggtgcgaatggtaagattgaatatttcattgtgaattttgtaatgaggtagaatcaatatcaagcaaaagtgtttaccataaggtgggcatcacagttttcctattatattgatttcacgaaaattattaatattttcatactgctaattgctcgttgttggaaattcaattcattgaaagggaaactcaatacaaaagtatttttactttccagatggtcaataatgtcatttggtaaagttatttaaaccttccaccgaacatgaaatcatcatagcattttgttatactttttttttaatcatcccaataaaaatatgattcagctttttattccagcaacctttggaattcatttatacctgttcattgactggaaatatctttctatcttcgttaggttatgatatttttcaacgcttttttctgtagtcatttgtagtccattatgaatccagcccaatctggtatgacttggtattccttgttagagatgatatttttatatacattatgtttttctaatagccgcaactatttcaggggttatgtaatttagacatatgcatttttcaatggaaataataaccaaatcgtatttaaaaaaatattgcctcatttttcatttttgaagtaatgagggaacatattccatttttgaccaaaaactatctaatgtccagtactaatattgatttttaggctgttctccagctttaggtttatatactctttgagttaatatgtgacagtgaattttgagggccttgttttataaattgaaaaatatacgaactgaatggagtctaacatttgaggttcattcagaatgtaagtagttatgaaaaaggcccaccactgagtctcacaggtgattcctccaataaagcttctatttacaaattttttaaatcaagtacctcttgatattatcaacctgttaatccattatcttttatttcttggttagttagtacttgctgtctgaaaagttttaggaaagtaaaatatttcaaatgcatatatttagaatgtttcatgacttattccacagttgactagtgtgttttcatagtcgaagctaaagttttaaatgattttttcaaaataaattattgtcattctgaaaatgagattacttctgtgcggatttcacattcgtactttaattaatcaatttataacaaaaaatatcatataactgctggttttatggtaaacactcttaaaatttcagcactagtttgtttttcactatttttgctattcatcctataaagtaaatggtaaattcacaaaaaaggaagaaacacaatgaagacaataataagtaatatccatacctggaatatataattttataaattataaacttatgtgaaagataaagtggcaatctgcatattaaaaaaacccttattgatatttagaagtcccggccatactaataagaataagctttatggttttaaatgttttcaaaattatgattattttctctgaatagatttttttttaattttcacaatttttttaaactactacttattggaatagcaataattgtggagaaaaacaaacactacgtcaaaaactaaaactcatattttgttctctgtgagaaatactagaattatatcagaaaatctatatatattcactgaccaaggtaggctactacaaacgctcaatttagatgtacaagtagttaatattgaataattacataacacaatgaagtaattcttgaagcggttcagttttctgaaaaaaatttatttttaggttaatcatatttactaatttttagaaataatcctcctcgacatttgttttctgtttagcgcaaaaccaatcaggatattgtcattttcccccttttctttaaattgccttttggcatttcaggtgtcgagaggaatatttcgtatttattaacttttatctcattagtgttatgtttgttttatgaaattccatggtaagacttaggataacagtgatataaatgataattttgaatcagtcataagaatcaaaatgatgtgataaagaagcagtgatttatttattactatccacttttctgatgtctcaaataagttgttgaaacaatattgtatataagtgaggattagtttgtagggtatgttctcgccgagaattttttactcatttccagtacagggagaaccaaaatttggggaaatcaaaatcgatccaatttgtattttgattctccttgtatattccctagttatctttactaagtatgcattcagacacaaagtgtttcataaatttccttcttaaaagtttatatattttatacttttgtatctcgcattgaatatttcactatacattttttctgataactagtcaaaaatctggggtcagtgtagagaatatgatatttcaaaataaatttttctaggaatataatagttattttgctagcattttgtaatatcaatttttttgtattgaacttctgtactaccaatgtataagaaataaacgcattttgtgttt

SEQ ID NO: 154 - DNA, 3592 bp, Leptinotarsa decemlineata
  Annotation=26S proteasome non-ATPase regulatory subunit 2; Tribolium gene name from OrthoDB database=TC004675; Blast E- value Tribolium Gene vs. Leptinotarsa Unigene=0
ggttaatattattatatttattacattcctaacattacaggattttagaaaaagtttatatcagcacaaaaattatggattgaaatcaggatttttccttaaaatcacaaaaccttccataattggtgttaaggctacatattcttcggtggctaattcagctctttcaccataagccaacagaacaggagtagtgtgagtttggaaaccagtaattgtctttggtttgcctgcctgaccaaccacatcaacagccaatcccactcgcacaggtatgggcagtggattcagttcctcatcaaatgtcacaagcattctaggttgcatagccgctgctaaggtataaagcagataatgagatcttcctaatattatatttttgacatccaagaatccaataagtgttgccatcaatcctgctacagctacaggactcatcagttgcctatcgctgtgataaggacttaaggtaagtgttcctttgcccagatgagtgagcccttgagcgatgcgaaccatgaacaaattgtttgggtccttggcatgaaattgtgccaactgcctcaacatggctgccagtctggcattattagtaccagctccgaccaatcccatggcgaaaatagcattgtgggcgacctctgcatcactgtcatgtgaaaacttgctgagggtgtcgagaatgcccaactttggattggacacggagatgagtcccaaagccagaggtacagctcgccgaatcgctggttcacaataacgaagtaaatgcccaaatgtcctgaaagccatttcactgccaatatcttcccccatgctaatcaatgcaataccaagtacggctacagcctgcctggtagatagatctttttctttaacagtttcctttttgtccttatctttggagcttttgtcggtgctatcagagccttcataatgctctgaacaaatgtgcagcaaattctgaactttgagaacgtttcccgttccagcgtaggcacaaatgtccaccattgttgtagccatcgaccggaaaggttcaggtatgacttccaaagtggcaataatagtatctataccttcctgttttcccaaatggcaaagacccagacccaaaggcaaaaaccgagcgtatgtatctttcagttctgtatctgatttctccattagagtttgcataattgttgtggtgacttgggggttgccagatccaacagcgatcataccacaggctaatgccgacatgcctattacttccatgttggatttaggatctgagaatactggagtgagcagactcaggacagcttctctgttagaaccaacgtaagccaaacctaaaccaacaatggctcctatcctcataatattagtattatgaagaacatagtcactcaagagggctaaggcaggatcacactcatttcggactccacagttgacaataccacaagctagcagagctccagattttatgtaatcttcggaagaatacaggtatttatcaattggagtcagaccaccatcaacatcccagaggaggactaacccaagggaggcggtggcactcagcattccatgctctttgtttttataaagccatttatttccatcctccattagaagtttgtcttggccgaaagccgcatttacgaatccattcacaaaactagctgctaaattttgcctggcagaatcaacttgactgcctccaaagggaggacgactattttccaaatgggatttataaacatcttcgggagttttcggatccatgatgtcaagctccctggcaagattcaggaagtgattgttcaagtggcagttagccataatttctataatatcttcatattctggagtactctcgggaatttctatgtaaatctgttgtctacccaacatgaaggccaactgcttctggatagccgtatctggacaagttgtgaatatttcttctatcagagaatgatcattcaactgcatagctaaacgtaatgcttgcgaatactgtttgaatttgcggaacagcaatagagcagtctgaagaagcgtattattttctggatcggccacatatggtatgcaacttgtgagatacaaacagcatctttgataattattttcatccacgtattgttctagtagatcaagtctttcaatttccatcagtaaatcacatgcttctgcttcagcattgtgagccatgttataaggaaggatctgcttagccagtaaaattaatttatctcttatttctgtgttcaccatgaaatcagtttctgcccattctccagcaatctctcctgccaagtgacgaacatattcgtggccccactctccgatattacccaaattagagagaagtctatatttgagacattcccttccttctcccatcgtcatggccaatacagaaataatatcagcaaaaacattttttatttctgggttagtgactttctcataagcttgcttcatagtttcataatgtggtttcatgaatttgagaggtttaggaacggacgtcatagatgtggtagatgctcgaatattattacccaaggcatgtagagcaggtaaataaagtttttcatcactttcctgtagtttttccacacataagttgagttcttcttgcagcagcttatcttcatcagacagctcatttttgttcttatcatcattagtttttacttcgattttggaagtttccatttttccctcaccgctatttctactttacgaaaaagtttgttcttgaaaacccgtttcccaaatttgtattatctgtatctaattattcaattgcaattctacgggagctcaaaatactcaactacttttcaaataactttgccaaaacacactgaaacacaatacaaattgctggtcatgcacatcatgtttctaacgtcagttgtcattttcccccttttctttaaattgccttttggcatttcaggtgtcgagaggaatatttcgtatttattaacttttatctcattagtgttatgtttgttttatgaaattccatggtaagacttaggataacagtgatataaatgataattttgaatcagtcataagaatcaaaatgatgtgataaagaagcagtgatttatttattactatccacttttctgatgtctcaaataagttgttgaaacaatattgtatataagtgaggattagtttgtagggtatgttctcgccgagaattttttactcatttccagtacagggagaaccaaaatttggggaaatcaaaatcgatccaatttgtattttgattctccttgtatattccctagttatctttactaagtatgcattcagacacaaagtgtttcataaatttccttcttaaaagtttatatattttatacttttgtatctcgcattgaatatttcactatacattttttctgataactagtcaaaaatctggggtcagtgtagagaatatgatatttcaaaataaatttttctaggaatataatagttattttgctagcattttgtaatatcaatttttttgtattgaacttctgtactaccaatgtataagaaataaacgcattttgtgttt

SEQ ID NO: 155 - DNA, 4586 bp, Leptinotarsa decemlineata
  Annotation=Tyrosine-protein kinase CSK; Tribolium gene name from OrthoDB database=TC010831; Blast E-value Tribolium Gene vs. Leptinotarsa Unigene=0
agacatacaaaatggtggttgttatatacattgaagttttgaaattatgtttttgaagtttgatatccctattcgatttttgaacaaaataccaaaagtagtaatatgttcaatatatcaaacttaaatatatgaaaactatgttgtgagaaacaagagtcttcagaagtgatgaccaaccaaaattcatctttccaacaaaggtaccagccttatattttcgatcagtttcgtcaacccgatgtccaatgggactcaacctcgtcacccaatattcctacagttcctcccagaggcaataaaagagttactccaaacgaggtttcaaattcgtaccacgatccttcctggatgaccccccatgaatcagcccaaaaaatggataataacgtaatagtacagaaatacacacgcttgtcacaaaatatgaattccactccagcagatagtaattttaggaatcctattggcaacactgatcatgatgttaatgttaatcatgtacaaagccctcaacgatcctgctccaaatatgctttttcacagtggtttcatggtaaaatatccagagatgaggcagaaaatttgttacgtccaaggtccgatggcctgtttcttataagagaatcgacaaacttccctggtgattacaccctttgtgtatgttttcaatcaaaagttgaacattacagaatcaaatcaaataaggacagactgactattgatgatgaagagttttttgacaatttagaagaacttatagaacattacaagaatgatgcagacgggctgtgtacaaaattagtaaatcctctgtccaaagattatgaagccttattttccaataacactaaatcacctgttaaagaaatcgacgacttgtttgtcatccccgaacaagaactaacgataagcgagacgataggcaaaggtgaattttgtgaagtgatgctgggaacatggaaaaacagcaaagtagccgtgaaagttttgaaggactctagtgaggcagaagccattctgatgatgtcattacgtcacgagaacctagttaatttattggggatagtgaggaaaaagcatcagatctatttgataacggaatacatgagcaaaggtagtttggtggattatctcaggtcaagaggacgacagcatgtgactaaaaaagatcaaatcaattttgcctttgacacaagctctggaatggagtatttggagaagatgcatgtagtccatcgcgatctcgctgctagaaatgtgttgatagcagagaatggaagagctaaagtatctgattttggacttgctagaaatgagaaaaatgcaacgtcggagtccgcaaaattgccaatcaaatggactgctccagaagctctcaaacaaaataaattctcaaataagtcggacatgtggagttttggaattcttttatgggaaatttattcattcggcagggttccttatccaagaataccactagcagatgtcgttaaacacgtagagaaaggttaccagatggaggaacccgaaggttgtccgcctgaggtgtatgaaataatgagacaggcctgggatttgaatccggagaagagaccgaatttccatgaggtgaaaatcaaacttggacatctgaaacagcagataacattgtgaattaacaatctagtttataaactagtagtgtttgttagagtggatgtggtatgtatatcattttatgcaggtattttttgcatatttcatttttgtttgatcaccctaattgacaacagcacttttttttatatcccaagttttggctcgaataacagacaagatattttttgaacccttttggtgctttgttggttgccccacaagattattgacgatgttccaagataactcataaagtcgttattgttttaagaaccttgtagataaaagtataaaccataaccatatgaattgagggccgaaaaaactccaacctatggagttttatagacaaaagaccccagtcttattttttttatatgaataatcgggacacatttgttatacagaagcacagtttttgtaaaaaaaattacttgacatgggttttttcatctactgaccttaaatctgaagacgaaacttggcactttggtcctctgagatctggtcatccaatagcattatttatattgtttaacgatatgtatgatattcatttgacgaatttagtttttcatgattaaaaaaaatcttcatataattgttaaaacaatacattagatataagtaataaaccaattaattagttacttggagaataaattgctcataatacaactaaatgaaaatttttaggaaacagcaaaattgaaaataggttcattgtttccgctgcaaaacagtggtcgaaaataatattgataacaatgcaaacaaaaccaacgaaaaagtccattgtcaaatgtcatttagtttataaacaattaattatttactctaccaaaaattactctcttcttaaaatatacccttcaattaaattaattacgttgttgtttgctgcagtatataaaatttctaaaatatgaaactccattataacgtattcaaaaaacacacttcaatgtgatatttccaattgaagtttgcagggccgcgacacgtgtttcgctatacgatggcatcttcgggcgcccgaagaagccattgtatggcgaagcgcgtgtcgcggttttgtggactttcgattggaaatctcacattgaagtgttttttgaatatgatacaattttgagaaaattattcgttttttataggaaaaaattgaaatgagggtctgcagcatgtaatcagaaaaaaaggtatcattcaaccgatgtttattatcggatgtgatttcctgtaataatcaattttgtgactttatcaccgaaagtagaccgaggcgccaagtttttacttcggatctgtgaccaacgaacaaaatacgttggtctaattgaaactttttcaaaaactagcttgattccaaaaaaaattcactgaataattgttatcaactttcttgatgggtcaagagttcactgtagataaaaattgtgaccaacaattgatactacttgtctgtgttatgatttttttttcaattcgtttctctgagagaacaagtaatatttatatatgtcctacttgcaaaacattccatacaagatccatttaagttcacattgttgctcgaataggaaaggattttgctctctacctatcactagtcaattaacagtcatacaattatgagaagtgggaaaagcattgcaaaatgaacttgttattttcaataataccattttctcctctcattttcccagtgatctatttagaaatatgtaaaaagttagccatttaattcttgaatgttattttataaagttttgttgaattaccggttctgttagtttttattataaatgctgtttgattcgggtggcaaaaataaatctgttttttgaactgtttcacagtacaaataccagtcagaaatggaagtgactgaaggagtttgaaattttgggctttgatatgtaaaagtaaacctgtataaaacaacgattaaattggcctaagtagtctagtatcaaattaatgtgagtaagactgaagttgacaggttttatcagtgcatttgaaatattgaaatgcaattctcaaagtcctcattcttcgtagatttataaattcaacagaatttgatcaatttcagattttggtgtggggaagttgttgaattctttctacatagaagtttctgttctgttttcgaaaaaagttattcagtagtttttgaaaccattcactgatattttcttagtatctttgtcgttgtatgaaggcattagaagaccacaaagtattttttttataatcaactgccgaataatcataattgatggtttgaactgtccattagctatattcaacagcataaaatgttgataatgactgattctacaggactaagcggttgattatggctacaagatagttagaactgtcgattatgaaaataattctctgtggtctttcagcgccttcgtataattgtccaagaattcaatttatagacttgtctcagatttaacccatggtctctttcctattttggtctgttcagattgctgctctctaatactcatatttacttgttctttcagtgtcctttggaaatgatgttgattgatatttttaaaagtaacaaaaataatattgcatttattataaattcgaaacttattatcatccaacgataccaataaccaagtttcagttgtggttgaaaactacccctgattagtttgaaaggtagtgatgttgtcattgtctaactaatctctttgtatgtggtgtggtttgaaaaattaaaagattccattgccgtactttgttaacgaaactagtatttatttccaaaaatttttatttatcatacataatatacttacaggattttgcaaaaagtttgttttgcatctacctatgtgtaaagtttgtttgcttgtttataattgtttctaagtattttgtattgttaagttgtatttaataat

SEQ ID NO: 156 - DNA, 1180 bp, Leptinotarsa decemlineata
  Annotation=Rer1 protein; Tribolium gene name from OrthoDB database=TC012860; Blast E-value Tribolium Gene vs. Leptinotarsa Unigene=3E-1; Blast E-value Tribolium Gene vs. Leptinotarsa Unigene=09
acacactcaataatacaaaatatataacaaaaacaataaataattttgaaatgtattataataaacagcttagctaggtacataatttatgagactgcaactttgtacattgaaattttcactcattaggtaggtgagtgcagggtggtaaataatttatttcttaccagaagagacaaaatattagtgaaatagaaataaacgcccatcaactcattacacttttcatcaaacaatttagcttgtaatacttaaaaataattcacaaagaaaatacctgaagagatattcacagtaaaatatacaaataacaaaaaaacaataattttgtttctttcgtggaaaagattctatttctatactgtccttttagagtgtaagcacgcctttcctgtacaaaagttgacatgtttttggttatgcctcctttacattttatttcattattctgtcactttggggtggtgataacttttcctgttgtttcttcatgtccttgatacttaggtttcccatgggtgaatggtaagtaacggtatttaatcatatgcctgatttgccttttcattgtgatacaaaacaaagtgatgaagtacatcaccagaattggccagaaaactggtatattgaaacattcgaagaatgtacagataattccaattactgtactcttagtaactgaataccagaatttaaattcaggtaacctccttatgaaaggtctaaattcttcatttgctcttgttggcagttcagggccattgtcttcagcatcaaaatccatggccggatctatttttggtgttaaaaatgctataaataggttcaagtgataaatacctaatgcatatgttactatgtaccatccctgtgctaaaagcactctgaccaaaaaaccaacgaccagtaggattgcagacaaccatcgaacttttcgccaaggtactgtcctgtccaccactccctggtaccactgtgaaatcctggcacaaaattggtaaaagaaaccttttttgcttccagaagagagtagttcctcctccatgatagatcacaggaaaaacagacctaaaactagttgagttataaatttactaattgaagattttcggtttcaatttcctaatccatttttgtacacgtcaatcggccaatctgtcaatttaccaaaccaaaatcc

SEQ ID NO: 157 - DNA, 5732 bp, Leptinotarsa decemlineata
  Annotation=MAGUK p55 subfamily member 6; Tribolium gene name from OrthoDB database=TC014139; Blast E-value Tribolium Gene vs. Leptinotarsa Unigene=0
agtcacgaaaaaccagccaaacgcggaacgcgcgtccacagtccatagcctactaggttcggaaaaggtatcgattcggtggtattcttgccctatttccccttgtgatttgtgatccctttcctttgtgccgttcatttcatctgtgtgaatttctctgtgacgtcagcgttgtagtaaagggagccgacgaaggttcaagaatccatcgaagaaccgccggtccttccgaagcccgccactaagatcggaggaagcatactgaaggagatccagatacgctgcagcctttcttggaacagagacgcccgtgaattaggttccctactcaactgtccgcatttgacagctctactagactgtcacgacgatatagcgaaatcttacgaaaacccgaaacaggaccagcccagttcaccgccgaaattatttcccaacggcatgacgggagacgccatcaggatggtgggggtgaggaaaaagcccggggagcccctaggattaacggtccaagttgatgaaaacagtaacttgataatagccagaattctcgaagggggaatgatagagaaacaaggtctgctacacataggcgatatcattatggaagttaatgggattccagtggcgagcgcagaagatctccaaacggagatcgccaaaaccaaggaccacgtcaccctcaaagtccacaataaacaaaacaacgaaccagcgacacattccaatatcgtgatgacgaacggtactaacggcatcacgaagaagttgacgtgttacatgagggccctgtacgaatacatcccacaggaagacacccttttgccttgcaaggagattggcctgcctttcgataggggagacatccttcaaatagtcgaccagagggatcccaactggtggcaggcaaaaaaaattgggggagatggtacgactggtttaattccctccctagaattggaggaaaggaggaaagcctttgtggctccagaagctgattttgtacataaaataagtatttgtggtgctcgaatctctagacgaaagaaaaaaatcatctaccaatctaaaagcagcgcagattttgacaaagcggaattactattgtacgaagaagtgactagaatgccaccgttcaagcgaaagactttggtcttgattggaactcaaggagttggtagaagaacgttgaaaaacaggctgatcaacagcgatcctgataagtttggtggagtagttccatatactactagacctcagcgagtgcttgaagaaaacggccagagctattggttcacagatagagagtccatggaggaagatataaagaacaacaaattcttggagtatggtgaatacaacggccatctttatggaacacacttagatacaatccgagatattattaaacagggaaaaatgtgcatcttggattgcagtccgatatctctgaaaattctgcacaacagctccgaatttctaccgtatgtcattttcattgctgccccgggtatggaacagctgaaaaatttgtacgatgttggtaaaagcaattcaaatctgaggcattctagtaggaacctatcgtttgaccgacagagttcgatacgatacagttccaggagagcaagaactttggaatctttggcttcactgtacgaggaggaagatctgaaaagggctttggaagatagtgcaagcatgcaaagaacttacgacaaatacatagatcaggtgataacaaataatgacttcgatacaacattcaggcagattgtagaagcattagacgctctaacgacagaacatcaatgggtgcctgtcaactggatatattaggattgttgaatagcatcgcttaactcaagtggaattcaaattgttaatattttggggtgattttttctactgccaataatcacatactgtttgccttagcaagtctttcttcaagaagcagctttcattttaaattgagcggtgagtgatgaatacacacgagggaagtacggtttcagataaaaaggatctcaaaaaagaaatttatttttggaaattttcagaatgaccaattgtcaaccaatattggaaggagttattctaaaggttcaatatgtcgtcaaagagacagctcattaggtaaccttgaaattctgaatgtattattcaaactccaattccagtcttatggtcactgagtcattcacaaatatacgtgaacttttgactgaccctccatgaaagttgacaatttgtcatttcagagtgaagggagctttatatattttacttttgcgaaccttttttcacttatggtaatacaataatcatcactattaaaaaatatatatatattgaaagagttatttagataagtttataaaaatgtgtagcaatatgaataagtattaaactgttagaataagtagtgatcagaaaagttttgaagaatagtatttatattgttataatgtctcaagatgtcagctgaagaatggcctaactggatttgatcggactcaaatacattagtggtatattttattacgtttaagttcttcgaatacatctcaacaatggtacaaactattacttacatcgaaatgaaagatctgagcaagagtgatattatttacagttcaattaaatcttgagagatgggccttgtcatgattttgttaaattttcatgctaactattttcatttccgcaaagtttaggattgtaggtaagaaacaattgattatgtatatttgtgaaattgtttctttattgttttatttatgttacaacatatgttgctaatgcagcgtatggaatcacagtcgcaaagtctttaacttaattttaacttttttattcgtttcacaggtgtatctttttcggaaattgcttagcatggacatatatatcatctgatcatggtaaataaacattttcatttggcattttccttatgccgaattatcatatgagtgacatttatctccttcactgacatcacaacccctctactgacgtcacaaagacagaaaaattgtcaaatatcggttctattcatctccacaagattttgtaacgaacaagttgagtataaagaattctatttgggaagtaatggacccaggaacaattatcgttactcctaattattccaacgaatccactcattttgtaaatacgaagtctacctaaaggtgtgagatatcacatgcttttgttaagtttttatcgaatacgaaaacgtttcaacagaactttcacttgattgattcagaaaaaagtgataatttcacattgagttaggagtaccacttattttttaacgaattgaaaataataattttgtcagaaatgttgtttccaaagaaagaagagtaataagatcacattgaaaattgagagtgggtatcagttattcctttacgaataaccaacatttccccatgatctcaaagaaagggtcattaaaaaaacctttttgaaataacacgattatatatgtgaaggaattattttacattgagttaggattactagttattttttaacgattcgatacatttcaactaaaaatgttgtttccaacgcaagcataaaaaatgagaattgaaacttcctctgtttttatagcacttttatttgtaactaacgttactgctgtttcgtcctacaaagacaaaaaatggccttacatattaattgttcatattccgacttcgggggtatacacacacgaaacaaagagaagaagaagaattcttcattttattatgagattaggcattgattttaattcttcacttttttcatattcacctacatttctagttgcttcattattactaaagtaatcacaaataggaaattttgaggtgacttgtgaagacattatcctgttttcaaatgtggttcacacattttgagacaatgcgcgccaaaatttcgaaatgtgattcacactgtcacatatatgttcaacctaaacaatttctgaaaaatatggcgaaaaattatattatgattagacattaattttgaaatacaaccgataaagaacacgtaaatgcagttttgagtattatcaatgtgatttttacgaacattttccacgttttgaagtataagatgaaactaatatcacatatttcgaagtaatatttgacacttgtgtgttctatggacattgaaatatacaaaaattactggtcatatttggttgtttttctatattgtttatttttggattattaccaatataaaatttgaatgaaaatttgttgattaaaatgaaattggctattatgtactgcatttaaatgttctttcgggattaatttaactgtatataacatttcgattgagatttcttatacacttggcactattctcgtcacaactgagactttaggaattaagttagttatatacttattagtgcgaaccgtccattttgtgttcaggagacatctttattttgttactgaatattgtatagaagtgcaggatttttttataattctgattattttgtatgtgtttatttagttttagatcttctttatacaagttttacgacacttgaagcttataaaacagacatataataaagaattttaaaatatttctggttcaattctttagcattatttgtaaagtctttgtgaatattacaattattattacatcgacactaaacagtaacaaaatataatactatttttacgagaaaagtagactagatttttttaatctcccaaatctagagtaattctaagaatgttttggggcgaccttgagaactttaagtcgataatagtatcaaaacaagaaatgatatctttttaatacgtcttcgctgttcaattttattagattcaagagtatttgctgcgtttgttttttaatatttacattcattgcagtcacaattttcatcctaaaagtaatattataaacctaaacatgacctatcacagttcgactaatggatctctaaaatcaggagtttgttgaagagaacggtacctttcaaaggtgttatctctcttcatcatcagttctttccagagacatttttcaatagcctttttccatgcatccgccacttctttcctttttgatttcagtctgtattcaacttcagagtttgtcatcttacttttcttgaagtctacaagcaccagttttgttggtttctctgaagatgaagggctcaaagtcaaatcttcggtatttatgcttcctaagtagtagaatacatctgtctctttttccctcgtaaacacgataatcttctcgaacatgaataccacaacgtttttcttctttttctgttgcacggcaaacttcagttcgaacttgtctttcattatcaggcagccatacccagtgacgtcgaaggggcattcttgtatcgatacgtggggagagacactttccggaaaaaactccttcttctcaaagtccgtgggagccgaaattaaactgtcggcgatgtcttcggttttgaaataagaaatgaaagaaaccaatcttgaatttcgcttggattttcgtgaggcgttccttctcgacagctcgggttcttccattccgtatcgggttcttcgggtcacttctcacttggcagcatctttcagattaacagaggatggctagcggagggttgggcaggtaggtacttatttattttgcggacccaccagcctctccacgcaatcttatcattc

SEQ ID NO: 158 - DNA, 4343 bp, Leptinotarsa decemlineata
  Annotation=Ultraspiracle; Tribolium gene name from OrthoDB database=TC009140; Blast E-value Tribolium Gene vs. Leptinotarsa Unigene=5E-31
attccaatttgtttataaaatatgttcatttaataaattcgaatatctgtgacaccgatattgttaacgttaacaaaaatatataacgtgtctcagctgcgtaagtaatatctgttcgaagtactaacttataaatgatcgcgaatatgcgaagcattcggccatgtttacagtatcgaaagtaggctgtgcgtttatttgtactttttgagtgaaaagcctttgtttccgattgttcaagaaggccgtgaggtgtctgactcaagaatggacacatcagacagggtcttactctggaccaaaacctctcgatgggtccgttgggtccccagtcgccgatggacataaaacctgacgcgtccacactccagttcagtccgcagggtcctaatagtcctggatcgttttcgttgggccatgcgaacttgctcagtccttcgccggggggccctaaaggggtgcccaattcgccgtatcctcccaaccatcccctgagcgggtccaagcatttgtgctcgatttgcggggacaaggctagcggaaagcattatggagtatacagttgcgaaggatgcaaaggatttttcaaaaggaccgtcaggaaagatttgtcttacgcttgccgggaggagaaaaattgtttaattgacaagcgacaaagaaacagatgccagtactgtcgttaccaaaaatgtcttgtgatgggaatgaagcgggaggcggttcaagaagaacggcaaaggacgaaagacagagatgcctccgaagttgaatcgacgtctagtaaccctaatgaaatgtccattgagaggcttctggaagccgagaagagagtggaatgtaacgatccacccgtagctttggagaatgccgtcacgaacatttgccaggccaccaacaaacagctgctgcagctggtggaatgggcaaaactgataccgcattttacttctctgcccgtttcggatcaagttttactccttcgggcgggctggaacgaattgctcatcgcttctttttctcacagatcaatgcagactcaagaaggcattattctcgccaccggactaacaatcaataagtccaccgctcaagccgtaggagtagggaatatatacgacagggtgctttctgaacttgtaaataagatgaaggaaatgagaatggataaaactgagctagggtgcttgagggcaattattctttataacccagatgtgaggggcttgcaatccactcaggaagtagaaatattgagggagaagatatatgaaaacctggaggaatacacgagaaccactcatccgaatcgagccaggcagatttgccaaacttctgcttcgtcttccggcattacgatcgatcggtttgaagtgtctggagcacctgtttttcttcagactaattggagatgtaaccattgacacattcattactgaaatgctggaaaaccagtcggatacttagcttttacagtaatttccctccaactgttgtctgtctttccctttaatttatctttatgaaactgtgatttattaataattgatttcgatatattttttggatagtggtattattagctatatttttattttcatcccaagggtgttgattgtttggaaaaagtttttttacgaagacgaaaaatatttgatcgctagctttaagtttgagcataattggtcggtatttaagaattgcaatatttaaatgtaataatcggattgaaggatagtgcgagatttcaatggttgctcaaaatgaatctcttccagatactgaaggattggttactattgtatttttttgtaaatacgctttgggttgttatagtgtgaattattcaaattattacatattcaattgatatttattcagttatctgtgcgtttatatttgggatgactacaaagattttttattattcaaatctgtctgtttaaaatctgtttttccgttcatcagctgtcgtccgcatacgaatgacaactctcagaagttgagaaacttgtgcgagctaaggactaacgaggtcttaccttatagcgtgtaattcctaacatgtaaaaaactcatgggaaatattggttattttcataagcaaccacattcacaaacattcaaatatcagttcttcaattcatttattacagtggatatttacatgaatgtaaaaatcaaatcttcgttatagctatcatatatttcattggttaggtttgctttgtcattagcgctatcctgtggcgagttgttttttacatgattaaatgtcatatgtcaaatacgtatacttcaaaaagaggaaatgccagaatgtaaaaattatcctagttatcttccaaatcatagtcatgaagtaaactcatgtccctctatcaaaaaatggtttataaatatggatttggttctgacattcaaacggggataaccttttcccaacgtataattttttgggaaaagttcatcctcgtttgaccaatacaaagttattgggatagaatataatttaaatggactaagaatagaaatgtcaatttttcaaagagccaataacttttagactggcttagaaataatcattatacagtttgtaatcaggcagtgtcacttcctactttaaattttaaaaaaatgacattcgacaattttcctaatcatttaatttacaaaattcatatctgtatgtttccgttacaaatatcaagtgttgccaaatatatgatgtctatttgtaacagttaactggtaactaatccttcagtcacataatgggagattacaaattttttgacttatattttagattgtctcgaaatcttgcatcttctagtgaatattgtatgaagcaatataaatataattcgttagaatagatctcttgatattatggtagacaacccgttaactcgttagcttgtagattttaatttccaatttttgttttcaattaagactgaattttagttttgatgaatttaattgttacaaaagtattgaagctcattttttaaatttgaaagttaaaaaatgtggctggtggcaaaatccattaaaaacagtgaatgtagaaattcgaacttcactttcataattttgaccatcgatgaagtttttggtttttccaagtttttttttcaaatgatatcaataaaacaaaaattttttgcttcaatcgactatgtctactgtgatataaaccatttgtgattctatgagatctatctctttcattattgaaatcctcttgttagcaaatgaggttagtgtttgaaaagctatctccaatagatctaaacagttacattgggataatagcataggtaaaaagtacctctttatgtttttttcaaatttttggttagtttttttctaaatggaataaaactgatggttgtgacgttactaacatttgatatgaacttggcaacaccgtaaaactcattcaaattgcataatttaatttttttcttcctgtattctggttgttctgactgtgtgtcagaacacagtcaaaacaaggccaatgtgatggttagttctgaaattggaaagcattccataacacaaaacaaagactttgtatttggaattttgagatatttgattaagtagtactatttaaataggtatgtcgtatacccaatcctgtactttttctgctttacaaacatatacatttttaaacgtggtttgaaaggaaggtaagtctcagtcattgttgaacgtcacagtcattgttgaaactttcattttccttcgaaatagaaaaaagttgagtgtgatttcctgatgaatgaaatattttcttataaaactaacgaataatattgattctaccttttttttgtaaaaaaatgaaatgtctatttatttatttttctcattcactttcgtgaaattcggcgattttgtttaaaatgtatttttttaaatttgcttagcagatgttccgcaatgattcgtttttattttatttactttcattttattagttatttatttgaccattgttcatcagttggattctattcaattgaaatgttgtgacaaaatatttttatgcatgaatggtgagccaattcatatctccttttatatatatactgccacttcagagaaattgtcttttcggaagtcggcaacttataccatatttccaacacattgctcagctattattgacttattacatacgataaggtcatcttcaaaggccttgacgagttgaaaataagtgttttgtttcgagcaatctttacatgagaatgaatactttcatcaacaaaagatttctatgaaaattagacaagatgattcttagagaaaacagaataatg

SEQ ID NO: 159 - DNA, 1410 bp, Leptinotarsa decemlineata
  Annotation=Replication factor C subunit 3; Tribolium gene name from OrthoDB database=TC006622; Blast E-value Tribolium Gene vs. Leptinotarsa Unigene=3E-151
gatggcgggactcttttaagttctgtgaggtttgcttatatttttgtagacttataatttgtttggatttcatcatctcaagatttttgaacacgtttgttttaaaagagtacagaatgctgtgggctgacaaataccgccctaaagatcttgcaaacttggactaccacaaggatcaagcttcaaacttgaaaaatctcacaaaagatggtgattttcctcatttactcgtgtatggccccttgggagcaggcaagaaaaccaggataatgtgcttgctcagagacttgtacggtccgggagttgaaaggctgaaaatggagatgatgtcttttacaacccccatctaacaaaaaacttgaaataatgactgtcagcagcaactaccacatcgaagtgaaccctagtgatgtaggcatttacgacagggtggtcgtgatggacattatcaaaaacgtagctcaaagtcagcagttaaattctaatgctcagagggatttcaaagtaatcgttttaactgatgtcgatgatctaacgaaagatgcccaacatgctctccgcagaacgatggagaaatacatagccaactgtcgcatcatactttgcgccacgtccatatctagggtgattcctgccatcaggtctcgttgtttgtgtataagggttcctgcaccatctgaagagacagtaataagcatcttgcagagtacttgtaaaaaggaggatctcactcttccggttgaacttgccaaaagaattgcgaaagtatcaaatcgtaatctgagaagagccttgttaatttgtgaagcatgcaaagtagaacagtatcctttcacttcaaatcagaacattcccgaaccagattggcaagtatttattaaaaagaccgcgggcagaatactgcaaaaccagaatatggaaactcttgcaaaggtaagggaaaatttgtatgagttgattaccaatggcattccttctgatattatattcaagactctactcgaggaattattaaaaaattgtgatatgggaatccgatcaagaattgtggaacaagctgcaattcacgaacataggatggttcaagggaacaaagccatatttcatttggaatcgtttgttgcaaagttcatgtatatttatcaggatatgatgcaagaaatgatgggcgatttttgaaatgattgattgttaaagttttcaatagaccaaaaatggttattaaaatttgagtttgatgtttaaagaaactagacaatttctggtacttggactattattggtttttcaattatacttagtgactttaagtttgttggaaatatgttatttgttcatttgaaggaccaggactgctcaacagctagttatttaataaaaatcatgtattttttgttcaataaatgcttc

SEQ ID NO: 160 - DNA, 1259 bp, Leptinotarsa decemlineata
  Annotation=Zgc:101748; Tribolium gene name from OrthoDB database=TC011435; Blast E-value Tribolium Gene vs. Leptinotarsa Unigene=7E-171
ttcacagtcatctttggcactattgccttcaattatttccttaggttcatcagatccataacgacgaatctactttttcaaattataggtttattcgcaggattcagtttaggtctcagagctgacaagctcactaaaacagcttcttccgttcggatagttttagaaccttgtttgggaagcatgttcaggtaatgatcaaaaagcagcttggggtcatctacattgagaatatcatcattttccaaagctgcttcaataccttgcaaaccaccaaacactaccagcatgtgattgaaagtaggacagctgaattcatctactgaggatcctttatctgaagtgcctatcgataggtcatagccatttttgtagggacattgtgaaaacactttagaaagtgaagatgcaattctgaccgaatatccccaatatactccagtctcgcttcttggtgtggttggcgatactacaacccctttccgttttttagattgttcattctgtggcaacaattttaccgtgcaccttattccagcagttaacaatttgtcgacatgtacttcctttgacaagccaatattgatgtatgaaccttgtccagttttggtaggtttattcattacaactccttccctaaatgagaactcttcacttggacccaaatgatgaggtgcattcaagggattcagaataccacagaatttcaaatctttatgaattggaaaaaaatgcttcctcagatattgagggcattccaggtattgaagtattctacctagttgaatacaagaatgacgagcagatactgtacctgcatcgttttccaaagtagacttcttagcagaagccacatcgccataatcatcaaatacgacaatttcatcaacttggaatatgcaagccgccctagcaatttgaccagccaaataggtgcgcagttccagagactgggcgttctctaaaattgatcctggaactgctatcgaaagtgttgataattctttcgattctactgtaacttccgattttatcttactgtcactgacagtttcattagatatttttgtattcaaaacttttttcaacaggcttttttcctttcgttttttcttctcttcttttcgagtttttattcacatcagcccaagttttctttttaagtacaggagaaactggagccatttcattaaaactaattaaaacttaaattggtaaagtcattaaaaattataaccaaaacaaaccatacagatagt

SEQ ID NO: 161 - DNA, 4832 bp, Leptinotarsa decemlineata
  Annotation=Endoplasmic reticulum mannosyl-oligosaccharide 1,2- alpha-mannosidase; Tribolium gene name from OrthoDB database= TC002991; Blast E-value Tribolium Gene vs. Leptinotarsa Unigene= 0
ttcatcatattaacaacaataaatatatcaaagttgtgctgtttatgaataaaataaaatttctctataaacatatttttcttaaaaaataatgaaatttgtgtatattcaggctgaatgagtaaaatcaaatttttttcatgactatgaattaatcaattttttttgagcaaaaatatgatctagtcatatattaatatgtaacaaattcataattcacaatattttaaaacacgacgattacaaaataatcaagttataattaatattttgtagctcagtgtattgaaagttggatgaaatactagtattgaaatgaaactcaaaaattctcaaaatatatctgaaatactattcaaacatgtgccacttcaacttctattatgtttttttaaatacatattagttggggctaatacatttcttgctttaaatgttaaggtattatcaagaatattcatagtaaactgaagactttcacctgaaggaatatcattctactagctacaacatggatttttgaattaaatatatgaaagactatacaacctctcaaaggtaaaccaccaattatttcttgttatattttaaattaaaatcaaaaaaacaacccttcccattaaacataattgaatatagtataaaaagaataacttttgtatgatttctactgtttttatttgttacatatagcaattttttcgatatgctacataaattcaaatatcaagattctcatcgcgtaattctcagaataatctcttccttcccattgaatccgttctgaatttttattcataattaaaaatgttatcactaaaacagtatatgaataagatcaatttgtgggtcggacacttctgataattctaatttggggtttatttataatctaaggaaacaataagtataatgaaggaaaaatattcaaaagaaatatgcttgacacaaaaatgaacaaatatgaatacaaaaacatcgcacacaatgtaaaaaataaataactcaatttgcaaaatacctgcattgagaattcataagaatgaacatcaattaatagcaaagataagaatattagaatagtacatcctattcactggtgtttactgcatttgtctagatattcaaaaaacatgaaaatcatagcatacttaagatatttgacatcaaaacgaatactaaaaagttatattttacactgcactaatatagcactttatcttctataattcaaagatgagtttgccatttttttttgtaaacagatgtataatacaggcaggttttttattgatctagcatatattttgtagtaagctatagttgcacccttcttgtacttcaatagatttcccacttcgattcagattgttgaagattaaaaatactttcttatagttggacttggtatttttttattgaaattatggtggttatgaaatggaacagaaagattaaaaaatatgaaaaattttgattgtgtacttccagcattattatattttgatatgatgaattataaaacttgaaaacgaaattccaacctttgatttaaaaaatcgtatcaaacaggcgaataacaggtaaaatataatataaattaaattgtattgaatgttagagattcaattttccactctataaaaaaatacattcaagagaagataaatgacgtagtgacaataccaagaccaaaatatttggacgagctagttgaacaaaagggtaaaaataatatctcaaacaccaatgaagatattatacaatgtagaagccgaggaaagctaatttgtaaagaaaacaaaaggtcattgcaacataaaatggaattgaagaagttatcttcaaagcaacatctttctttatcttctcttagatttcaaatctatcaatacttttttagacaattgcacttctaacattcaacaagaacattatccatcacattcaaacaaaaattaaaatatattttgcatggtgaaaaaataatttttattgtttatatgcaaatgagtaaaacaatccctaaaatttaccaaaaatataacgaataaactaatgtataatgtaaatactacccaaaaatttaacataatcaagtattgaccatatggtctatctgcaatagttaaaattcaaggattaatggtatacttcaggaattgatagatagtttcttggaaggtggataaaatgacctcatcgaaagcataacacttttgtcaaaatacttcagaatttataaataattttttgttcgtatttcaatgactgtccctgcatgtcaattgtagaatttttttttaatgaatataagacttcatagtattattgcttcagagtagaaataaccgaaaagtgtcttatacagacaactatagatgaacacatttttgagtctatttcgttgaataggtgttaaatgtatatattgctttttattgttacttcaatacaatattgtcatcaatttaaaatgaaaggagtatatttttaggagattaatttttggaagattaccacattctgttgtatcaagatggagaagtagaaagccaaaacctatcttttccaaaaattgtcatcgatgtactggggagtatctaggtttttaaatttaagcattaaactcagaaaaaccattgatcattgtgctttaagaaatcatagtaacaaaaatatgaatattaaatgtttcatcaggcttcaggagtgaattggtataccactaaacccactactttttgactagtttataaaagatgttattacttgaatgataatgctttgttactaatttcttgaacatcataagtatataacatattttgacattgtaatggtgtgttctacttgtaattcacaacaatcaaatacactatcccatgatttctgatctctacatttactttgaaagtaaagagcaaggactagagaaattcagagtaaaatcaaatgaggaataatcaactcagatgtatgggcagtggatgagcttctgaattgataacatattcgtccaaatttaataattttggatcgtcactaaataacaagtacaaatacttcaatgtttcactaaggaagaacgattccatcatgtctctcggtctcacattagcagtatttttgacgttgcctatggaagtatatccgttgacgactttggtatatttctcaaaggcttggaagatcttccaaccccactcttgataagtggaatcgtttgtgaactgatacatgtaccagaggctttcgatgaattctggtcgaagaagattgtgagcatcatttgattttacatgtaggtcgtttggattttcaccctgtatattaaaataagtaatctcaggtgctaggaatgtaggttgctggacataagtttgataacaggttttcatgagatcattggcaagcctaagatgcttctttggtaaaccgttgtgaactcccaaagccaaagttcctggtaagtaacaagtaagatgatccatttttggtttgaaatctctacctcctcccaggagttcaccgatgaaagtatatccctttggaacagaaactcttaaaagatgtttctctatcccatctatactttcaataaaatcatccttcaaatagtctatagatttaccagtttgaatccactgtttaagtaaatattcataataactatcacctctagctcctaaagtaatagaagcatatgatctgaattgaccagtatttgcattgatgaatattggaactaaaccatctttcttttccagtttatgaagcaacctcgatactttatccactgcaatctcatattttggatctcctgtagccctacttaaatccctgaactccagctgtattgtactaacttctgaagtactactatcaggagaccattttggagcatgaggttttctagttctcaaatttatatccgaaaacggaattcccgattctgaatcgaaacttggaagaagccgatcagccaaatccacagccttctctaaaaacatttcatctttggaaaaatgatatatactaagcaggccacctaagacccttatcgtaacttcaaataaattgacatctttatcgatatcaaaattcagttcgttctttacccagtctcttgcctctttgaactcttccttgagtcccataataaatattgtatcaagtgaatcaacgatcgtaagtcccagtccgaaccaatcactgtagccctcagagattggtttaaggttatcgtgcccccatgcgtattgcttgtatcctttccaggcatgtttgaatgctttaaccactgccttctgccttgaagtagttggacctgaaaaacgatgctgagttctaggtggcagcagtacttgatttctgttgacagtattgtcaacttcagctcccccaggttcttctaatccttggttctgttgaactatatcatcgacagtgggaactgaattaaagtgggaatctctggaagagtcatcagtatttctggacgtatattttattctaacattttcactgtttaacatggcaagctgtctttccccagacaccaagtaaaatgcagttaataacaatatagcaagaatactgaagatgaagcttctttggcattttgacagctgattccaataccttttcaaattctttgttttccgtttgtcattagacagctctgttggaacatctactctgatgaaatcggatattttttattataattcataattcacctaactaaataaaaaacatatctatataacctacaacccatcatagataatctcgacttgatcgtgatctgtacacgacacaccactttt

SEQ ID NO: 162 - DNA, 2112 bp, Leptinotarsa decemlineata
  Annotation=Methylglutaconyl-CoA hydratase, mitochondrial; Tribolium gene name from OrthoDB database=TC005614; Blast E- value Tribolium Gene vs. Leptinotarsa Unigene=2E-65
gagtataccttcgacttcaaggttgtatcttcatttcagtattttgtatcactcttataacctggtctactgaaattagatatagattaataggttgatcaacatcataaccccgaaaaattggttatgtaaatcacaagtatagtttttggacaaacgaactttaattgacgccactttattcgtcattgttgccaaacaactcaaacctatcttctcgagcaaatctcagaacaattcaaataatgaattttgaaatgttaaaatatttttaatgttgatgccacgaaataccccgaagtcttcatttccctggtggtggccgcagcattgatcttgctgctgaagacagtttttgagagacgagagaagctatgcgagaacttcttttccacatgtactctctcgttttgtcgtggttatcagcactgtccactctcacctgtttaggctgtaaaaccctgattgaatgtagagtagctgcgccgccgtgcatgattcgcaaattcagtcttccgtacatttcagctgtggttgctgttgcacttttcaattctctccgggcacctttaccaaactccttctcaactctcaaggtcagtggtcccaaaacgaagtcagtcttcacattggtatgatccgacatcatgataaccgttacatcaccatctctcctgatagaactcaatccgaacaaggtagcccttgactgttgtttgtttttcgattgtttatttttgttgttcgactgtttcactttgtttttgttccccgacttggttgtgttctttgttttgtttccgggctttgttttgcttcccgatttggatccattgccagattttgtggtgtttttccgcctgtttttgttcttgtttctctgtttgggtgaatcggatcttagctgggttgttgttactgttacgttattgagaaagtcttctgatccagctttcgaaatcaggatgaaggtgggctcgcgagtctcactctctaacggtttgggctcatctgttatagcattagcagacctcgcaatcggaacctccgccattttattccgtacgtctgtggttttgcgttgggcatttcttcgcttattcttcttttttcctttacccttcgactttttcttgtttcctttggctttgttcttagtttcggcagactgaagtttaacccgaaccggatcatacgactttcccaaaattttattgatgcggcctattatgttgtccacgaatctgttgtatttggaaatataaattgctggcattttgggttgtcccatttgaatggaaccttcaatttctcctgcagcttgttcctgggcgtccaattcctcgcttgggctcagctcggaaggtgcagcttctgggtctacggattgaactggggagggttccactaccgttgattcttgtgttcctgccgaaggagcgggttcgtcttcgtcttcgtcgtcatcgtcgtcgtcgtcgtcatcgtctccacctcccagaatgtcatcaaggaaacttccgaaatagtcatcgtcatcatcgtcgtcgtcgtcatcatcatccgatgcgacactgtcgtcatcatcgtcatcatcatcggaaacgccgagatctaactcgccatcgtcatcatcgtcatcgtcgtcgtcatcttcagattgccttcctttgacctttcccttcgatttcggcttcctttcggccacactaacttcggtgtttttcacttcctgctttgcaactggcacttcattcgtttctactgaaggatcggattcaggctctttcacttcagtctctttggctacttccgtaaccgttgcactttccgttttaaaaacacccggagtttcttcttggatgacaccttggttttcgataccgatttcgtcactgggaggtcgatcatcagccgtgaacgttgttatcgggtttgccgtgattcgaagcaggagaacgcacaggactgcgccgagaaagtatagcttcatttcgaatctaccaccggatccaatagtaggtcaaacgctacaaaacgcactgtaacacttgtttaaagtcaaagaaccaagagccgcaagtgctacgacctgatctgaccggaggacga

SEQ ID NO: 163 - DNA, 1091 bp, Leptinotarsa decemlineata
  Annotation=Serine protease P55; Tribolium gene name from OrthoDB database=TC013613; Blast E-value Tribolium Gene vs. Leptinotarsa Unigene=9E-58
accctgaaaccaggctctatctccaggcttcaacttgtctgcgaaccgataagctagtgatggtgtgttgtccgcaaacagccaatgtcaaaaccattgatgacgatagaaattcaaatggtgacaacgaaagcacagatgcaatttctagaaataatgatgtcaaggaaaagaaggcacagctacttagtaaacctgattgcggtttgagtaatgtgacgaatgcaagggttgtaggaggaacccctgcaaaacttggtgaatttccttttattgtggctctcggctacaggaatcccagtaatcccaaagtgccaaaatggctttgtggcggtactctcattagcgaccgacatattttgacagctgcacattgcgtttacaataggaaagatttgtatttggctcgtcttggagagcttgatctcttcagtgatgacgatggagcaaacccagaagatattagactaatcaaggcaaaagttcacgagaattatagcaatgttcaatttaccaatgacattgccatattgactttggagcggaaaccaactaatccctctgtttggcctgtgtgtttgcctcatgaggaacctctacggtctaatactttcctcaagtattctcctgttgttaccggatggggagccttatacttcaatggtccttcaagttccactctgcaactagctgagattcctgtagtgagccaagaccattgcaagcgtgcctttggaaaacaaactgtaattgacgacagagttctttgcgctggttggatcagtggacttaaagacgcctgtcaaggagactccgggggtccgctaatgttcggtatgagcgaaggaagggatttgcggtactaccaaatcggagtggtgtcttatgggttcagatgtgcggaagctggatatcctggagtgtacaccagagttacgaacttcatcgactggattcagaggaatatggactagttggtggaagtgcagtgaattattggaccgaagtattgtgaggtcgtttggagcgtgtttttttttttcgatagatacgaccttactcgaaaatgaaccaacatgacggcatatgcc

SEQ ID NO: 164 - DNA, 1157 bp, Leptinotarsa decemlineata
  Annotation=ADP-ribosylation factor-like protein 2; Tribolium gene name from OrthoDB database=TC012465; Blast E-value Tribolium Gene vs. Leptinotarsa Unigene=7E-6; Blast E-value Tribolium Gene vs. Leptinotarsa Unigene=0
aatggtctctttctaatggaaccattcccacaattctatgaaattatataaattcaaatttttgtttaccttcaaacatcaaattgtacataaataataaaaatacaactctacttgtaaaggctacctaaataagtgcaatgggatttttaacggtgttgaagaaaatgaaacaaaaagagaaggaaatgagaattctcatattaggattggataatgctggtaaaacaacaataatgaaaaaattcaatggtgaacctatcgataccatttctcctactttaggattcaatattaaaactttggagcatgaaggatttaaattgaatatgtgggatgttggtggacaaaagtctctcaggtcctactggcgaaactattttgaatgcacagatggtcttatttgggtggtagacagtgctgacaaacgtagattagatgattgcaggtctgaacttcatgttttattgaaagaagagaggttatgtggtgctacattgttgatttttgccaataaacaagatttaccaggtgcctgtacagcagaagaactgagagagattttggaactagataaaataaaaacccatcactggaaaattgtttggtgcagtgccgtaactggcgaaaatttgttgaaaggaatgaattggcttataaatgacatttccgcacgtatatttactttggattgattttcataataacctttcgaaattgaaaaccatcgttgctaatttatgaaatatgccaccaatatgttacaataaaagctgtgttttctttctaagaatcagctttttctaatatttttttaggacttgtggtttgtgcttttatcagaagtggtatcattgcacagtccgcctgaaaaatgtttgcatattctaattaattgaaatttgtgacatgcttatttaaaaaatacttttatctatctttattttgatgtctcaaatcttatttccagttaataaaaaaaaaatctcaattgtttttacaaaaccccttctctcaatgaccacaaccgtaatacgtgcatttcaccaactaagttggggtcaataggagatggagacagatttttttaaacagatttgaggcctcaaatgtctccatcttctggatttaatggtgggtcaagcaaggttctttat

SEQ ID NO: 165 - DNA, 2115 bp, Leptinotarsa decemlineata
  Annotation=Acyl-CoA Delta(11) desaturase; Tribolium gene name from OrthoDB database=TC014819; Blast E-value Tribolium Gene vs. Leptinotarsa Unigene=0
gaaaatgaacaacatctgcataacagtgaactgcttttcgtatcaaagctattttgatatcaaattgtttaccaaagtttttgcaatttttttttaaacttgtacctacattctcacattgtgaaatttttggataggcacaaccaacaggtgtgtgaatttggcaagtgctttgggtggtgatacggccaaagagagtctaagttctctgaaaaattcctataggtaaacactatatcaaactaagaaaattcttataaaaatatgagttattttagaaggcacaaagtttgttataaaaattaaagttttatagacaacatgctgtaaaaaatatttttatatatatatatacctaatcataattcaaggaatgatttggttaacaactacagactgtttggaaaaaggagcttttgacaccaaaaaggcagtactaacgccaagaaaggtcgaatcaaataaaaaattattatatccaaaagaacaaacttgcaattattagtttctggtataataggtacttcaataaaaggatgatgatacaatgcataaatcgctgaaatgaaacttctgtttttcagcgagaagtaaggcagattgcattattcagtcagaaataatacgggaatcatggaaaattagattaagaaaagagaatgacagacgattatatcttactgtttactctaacaaaacatttttgttttctgaaccctgttttccaaaaggcaaagttgggtattgagaaactctccggaaagtttcaaaacggtttgaaccgaaaaacagttcgattattcagtagcaaaaaacaataaatatatatccatacatttcataacatcaatactgtgtaattctcttcaattttcatggtcatcgcattttttttcgaccgccatgttcttcagctcgatcttatcctcttcttcgatatcgctgtcaccataaccccaaatttggggatgagatccgtcgccggttttctccgcgcgccgcagtatcatattcttcgaaacacttttcagctcgtaggcccaacccaatttcgcgaagaagtctatgaacgttgtcgagggattgtaggcgtttcccaactctccggtcttgtagtcccacgggaagacgtggtgatagttgtgccaaccttctcctagtgcagcaagagacaccgcaaggttttcgaccgggctgatatttttatcataaggtttctgtccccacatatgagctacgctgttgacgaagaaggcgatattcaaggtaattgtgaacctcatagtgaagtttatccagaaggagatccataaattttcgttccaataatgtacgggaatgagcactggaagcaatatgttgaaaatgaggaagagtggagggtacaactttttctgccacatgactatggggtcagcttctaaatcgctcatatctaccgattttcttttttccactacattgggatggggcgtcagaactagccatccgacgtgtgagaagaagaatcccctttttgcgttgtgcggatctgcgtctgtttcgctatacttatggtggacccggtgatccagagcccacgcgtaaacatgcctctggccggtaactgtaaataaaatgactagaatcagcctcagcggccatttcgctttatacgctctgtgtgaccacagcctgtgagccccagcagttataccgaagcctgtgatatatactgtaaggaatgcaaataacgtcgtataaaatttagccgagacaaggcataaaaacagtccatataaacatcctatatgtagaaaaagttgcactatagtatctggccatcgtatttgaggtacaaaatcttcagttttggtatttatttcactggcagtttctattttttcttcattattgttttttgttgtgattctttggtgaattgtggtccctatgtttccttcgctagttgccgggcacatgttcctcgctgtttcttcatcaaatccctcagtcatttcttgaagaaaaatttgtgcagcaaaatatattccaagatttccagtgcactaatttacaaaaatcgaaaagggaatcaaatacgtagaaatggggtgatccccgaatgtttttaac

SEQ ID NO: 166 - DNA, 4298 bp, Leptinotarsa decemlineata
  Annotation=cAMP-dependent protein kinase catalytic subunit; Tribolium gene name from OrthoDB database=TC011652; Blast E- value Tribolium Gene vs. Leptinotarsa Unigene=0
tttaaacaatataatggtcttttttcaaatacatcaattctagatattctgtttacagtaaattgtgattgtggaatgagaaaccgacattcatttttgtgtactggccgaattcacacgttccgaccaaaaattatccagcaaaccgaacggagccacgaaaaatccagattgtacaaagtcggccatcacaccctacttttgtgtgatcttctaaacccgtaactaactgttatccatcatagcagatgatctataaaataatctcacttctttcaaagaggtatataagtataacatcacataattgaatttgtaaaaatcatttggtatatcgtaaaaaaaaatgtgaaaaaatgtcatctaccatgatgttgcttgtgcttaatcgagtgcaagagtttcaaaaacgtgttccttaacaatttatctgtttttgaagatgatagatcaaaattcagcgtacggcaatgtcaatcgtcctttcttgaagtttcaataacagaatcaaggctattttcataaattctcatatatcgcacttaatgtcttcaatgacgatgtttagagtttgaaaatatattccagaaacgctttattgtgagattttcactaaacagttttacaaaagcacaaaacgggtttcggtgtacagtagcttcttcaggcatgtctttcagtcaagagtaaagtcgaaatatcgagtttcaaagtcgtaatttccaagaaacgaataataaaataatgtggcacttttgcacttctgtatattcaagaaatgaactacgaaataagtgaaatgtgttggtattccaaggatctatttccaatgagattttcataagtcattaaaatcaagaggtttgaaaaaacttgtttaggtaccacgttgttaagtgactacaaatgtgaaaaatatctgtgtttgcaaagaataagttgatgtcgacttcctgcgaatgaattcaacctaagttcctgataaattttcaatgttatttgaaaaattcaaggaaataaaaaataccaccgaaagtggattcctaattctaatttttcagtatcaaattttcatttttgataactggaatatacaactttcatcattttagatacgagaatactggaaaaattaaattgaatatcttttttgctgatatgtttcatttggtgtatttttcaaacaacatcctacattccgtctcaaatctatttacaggatgaagtcaataccagcccattttatctgtaatgtcgattgaaattgttttcatatgcttcaatggtcttttggtatattgtgctagaataggagacgtaacatgaatgctgaagattttcataaacctctggatgttccaagacgcctgaatcaaaaaaattagctgtgatacgttaacaaagcgattatcaggaccgtaattgaaaaaaatataatttacttgctgaaactttcaagaatattgggtaggacagtaaccggttgggttggcaacagtgatttgttccacacattcaattgaccgggtgaaacggtgattcgagccgagggaccaaacgatcgattttcactgcctatcgcccaacccatgctaggcatcgcacgttgaaaggtaagacctcgttaatccttagctcgaaaagtttcgacttttgagggttaacaactggtaaacggaagaacggatttcgaaacagatttaaatttaatttccctaattatttttttttttatttcaaaaggatggtaggtcaagttgggcgatattctttatgaaaattctgatattctggtagttctgatagctcttattgagcgaaaatgatttccaatatgactgtaagtgaaggagatgcaataaaaaaaattaaatcatttagcagtactttttctacctcttacaagatcccccaagcttcaacagaaatttgggtactgctgtataataaaatatattgaatcagtgaaaccgactctttcaaagtcagaattgttttgatatctcaagagttatggagaaagtatggcccaaaaaagaaatacctcacaaaaaactacgtactaggaataacacattacataaaccaaagaaccgtcatgtcaatacgtttttggaactcttgcgcaattctaacactaaaaattacatacaccggagcgattctgcattgaggagcatgatccgcatttgcgcttgtgtgagaggggaagacgggggatgagatgaagaaagagagaatgacacatatcgagaggggttaagtaagtcatcatctctccaacagttgaggtaacagggtagggttgatcggtatcggttgagtccgaggcagttgctttttcttccgcctaaatggaaaacagccttcattttctgaaattgctataggttgtaaaactaggtcgggcgttctggaaccgttggggccgaacacattcaactgccgaaaacagtccgtctcaatcatttccgtttgccaaggtatcgacacacaacccgtgttgaacttactataaaaagtcgcatcactttcgtctatatttacacctttcactgtcgaaaattgttcaatgtctagcacgtcctttgcgtacactgcgtgaggatctggaacgaaaggaggatcgatcatccccgcctccagccgcctccaattgatatgaggatagaaaaaaggatgttgcttcacgaggcaagcgccccctcgtcccgccttaccgcccagccgctggtgcgggctcttcgcaagcaactgttggcacagagatttcgcttcttcgctgaacttgttggagtacttttcctgttcggttttcacgcgtctgtcgacctcctcgcgctttaccttctctttccgggctcggaatggggcctgaccctctaacatttcgtagaggaggcagccgaagctaaaccagtccgggctgtaagtgtatcgctcattgtcgattacttcgggagccatatatcctacggttccaactctacctctaacagactctccttccggaatatctacagctaaacctaaatctgagatccttacgtgacctgtatcgtctagaagaatattttctggcttacagtccctatatacaatgccctgctggtggagatgatctaacccgcacaccacctcagcggagtagaacctcgccctggctacgtccagccccggctccccgcccatgttgtagatgtgaaacttgagatcgccgccgttcatgatggtgaggacgaggcagagggcgtccttcgtctcgtacgcgtacgccaaattgacgacgaaacgagagttgatcctctggagaatttgcttctcgatgaggaccatcgcttcccctttgcgcttcttgatgcgtttcttttccagcttcttgcaagcgtacattttgccggtcgctcgcacctgacacgcgcacacctctccgaaccctcctttgcctaacaccctgtacatcctgaaagttttgtacgtgaccggttgagcctcaagccacttccactgcaggtatcggtggaagtacagcgacttggtgaactccttgaacggttccccagccaggctttctttgacggcttggacacaaggcgcgaatagatccttgtggccattggtgagtttgtcgcacgaggaaagggcaaatccaacctctggcagagaaatcccctcttgtccttcctgtccgaccagaaactccttcttgatgatgttggccagctcgagcctctgttcgtcgttctcgacttcatatcttttggcggcgtcgaggaatttgaggcagcggtggtaagccggacccttgtgttcgcaccactggtcgaagaggagttttccaataggttgatggtccaccacatactcgtaacgcacatctaatttgttgataagttcgatacactgcgagatgtgcggaaactgcagtatcttcctccacttcttgctctttcccttgttattatcggaaccaccctctctcgcttttagataaactgtattcgcaactatgttttctagttccatgagttccagcttgattgtttttaaaacccgccaagtcgggcctctcgagacccgtttccattaaattcaccgggcgaaatttttgaaccggaaaggggtgtcccatgcacttgcttctatcactggcgatcgtccacggcaccctcaaacgcgaaagcacacaaacgcacactagatcattgcacacgttcgctgtgtggactttggggtgtgtctaaattttaccctgtacactttgcaccctgtgatgtgtcgtatgcactgaggaaacc

SEQ ID NO: 167 - DNA, 1747 bp, Leptinotarsa decemlineata
  Annotation=Putative uncharacterized protein; Tribolium gene name from OrthoDB database=TC012215; Blast E-value Tribolium Gene vs. Leptinotarsa Unigene=1E-37
ctgtgtcaaattttcaaaatatgcttatttattgatttttactagaaccaagagtgaacataggtatattaagttttgtcaacaatttcaacaaaatgaacgctgcaatcaacattggtgttgaagacatgacagcaacgattgttcgctatggattatatttgggagctatcttccagatcgtctgtctagcagcttgtatattcatgcctgattctccagaagacaacagttcttggggatccagagttgatagtgatgatgaaagctctgagcagagtactccgcaaaatactcccagaagaccatatcataggaccaggaagcaagaaaagaaaaaaagacgttgaaagaattcgaaatatttttcaaaaaatgttatcagtatctatgtttgatctccccaaaaagtcgattcagtcccactttttgattggatcaaaaatgtggatgcaaatgtaatcagtgctactgagattagtgaacagtatttattttctgtgatgagcaaaatattacaaaaaatggtattgccatgtgttttttgaccttgctgttttcaacatgtttataactttcttacattttaagtaatcaggctaggatgaaggtcacaaaaacaagattagataacatacctggactagccaattttgacaaagaaaaacaatttttttttagagaaaatcaaatctatctcaatgaataagaagcaaatgcaatagattaaatatggtttatgttatgttatttcaatagcttccctgcataatcttttctatgttgtgctgtagtagtcagtaaaacttacccaaatgtcatacagtaacacttattctttaatgtatgcttatccaaatttctgtgtatgtcctagaaagcagtttgccagtatattcttgtctccttttctttactgattttatgtatggttctaatatccatttttatggaagtatggatatggagcgttttggctttctgattctaaagtaaggaagaatgaaaataataacattgaaaactctttataaaaatatgcaggttatacacacaatttttctcatttgagggaaacgttaattcaatgttcaaatgagagtagactttttcctttagtgcaattcagtgttcatgtgaaagtaagtagttgtttaggcatagttttttctttcagtttgaatctgaaataaatttccgagtatgattttcataaagagtttttattgtatccatttttctgcccggaaacagaaaaccaaaaggcttttttcccatattcatgtatatttttttatttcaggcttgaaaaatgatttatataaatcttctaagtaaacatcctattctctctgcgacccttgtcaataatggcagaaaggagataatttcatcatttataaattgagtataattaaagaaaacagtatttcgaaggctggaaaatgtatctaccttaggtatatattcagcgatattatagaactatgaaattatctcctggtattaacttttaacactaactagagtgtgaacgactggttctattacttcaatgctctcattcaagtaaaatggtttcataggtagttatgcccgtaatgatttttcaactcttaagaattacatttcttcagtctctaattcaattacgccccaattaatctcaaattgaataattagtttaaatcaaatatttaagcaacattgtagatactcattcaagaataaagaatatccaattcag

SEQ ID NO: 168 - DNA, 2085 bp, Leptinotarsa decemlineata
  Annotation=Pyridine nucleotide-disulfide oxidoreductase domain- containing protein 1; Tribolium gene name from OrthoDB database= TC014309; Blast E-value Tribolium Gene vs. Leptinotarsa Unigene= 0
tctagttagtttttaactttttttttttttttttttttcgttatttaatttttttttaatatacaacaaaaaacattaatcaaaatagtcttctatatctatatcgggattaagaatgtcatcaccataaggtgatagatcaatctgattcaaaattagattttctgccatttcttcaagatctgtttcaccaatcaatacagctccttgtagcttattattttccaaaacaaatttgatgaactcgtgtcccttcgtcattctgatcaatatttcataatcattccccaacttttgtccattatataaacctaatagtataactttataaccgaaaagtttggtagaatgtgcaaacatttcaaaacaaaaatcttgtaagatctcttcgttattcaagtgtcccaccatgcattttgcagcatagcaccccatttgccgtgcttgtgtccacaatttcatttgaaaccagtgtttggccaggggccaattagccgaacaaacatcgcctgcggcataaatgaatggcaaattagttttcataaattcatttacttgaatacccccatctttggatacttccagttcatttttaattttgaaggattttcttggagtaacacctgtggctgaaattactaagtcacattctatcttttcttctgttgtcaacaaaacttccagggagaattgacaatcagttaactttctgattgataatacttcagactcataatgtatgtttactgctgccactgaaactttttgatttccagctccactgattataatatttttataccagtcaggtcccaaagccgcacctgtttttatgaaattgtcttccacatacctcatcctcttgctaacaggttcctcaaattcatcatttttgtttagagaagattgaaaaaattcagcagcaccaggatccacgaatgttgcagttatatatttatctttaataacccaatgtatttctacatttctcattttgtataccagctctgaggctataccaccattcccaacaattacaactttttttgcatcttgcattttgttcaaaaattgatctactgaatcggtgtctctgatacctataatttgaggaaaggtgcttgactgtggaatcagttttggctcagctccggtacagatacataaatattgatacttgataactttgttatcatgtgttactatatatcgttcctcatcatttatttcagtcaaagtactatgaacaatagtaacattgggatgttcagaactgaacttctcacattcaatttcttttatatcaaactccgtaagaacttttgtgattgcatgaagatttgttacacttttgattaatgatgattcacttaataaaatgacagtttttttcggttcaagcaatgataaattttcagcacatgtaacgccagctatacctcctccaataacaacaaaacacgcctccattatttatttttcagagtaaaattcagaatagttatatttcctgatgggtacatcaaaagttattaaacctttgtcgtaagcccgttttatgcttacgactagttgttggtgcttcttctgacacaagcctgttttagaataactcaaaatatttccagtatatggacagatgaactgcttcagcaaattaacattctcttcatgcaaaactaaatactcatctctacaaatagggcaaggattgcctgtcgatatctgaccaccccttatgcaagtttttcttgttttattgggtggatataatcctttgtgatttcttctataaagtacccacactggctgtccctcataggttttgtgaaatgcagcacttttcaggtatctgatgctagtttccacgggaatttgttcggttcgatctttagttatttccctagtttcaagcactggttggtcatcaacatggctcgtaagagaaaatgatgtaaacatcggcctggccgaacagaatttcgtgaaattatttctcactaaaaacacagaaaacatcttactttagtttacgtttctctctctttgtatggctgctgcttccctctcgggcgcatctggcca

SEQ ID NO: 169 - DNA, 2517 bp, Leptinotarsa decemlineata
  Annotation=Extra-extra; Tribolium gene name from OrthoDB database=TC009463; Blast E-value Tribolium Gene vs. Leptinotarsa Unigene=1E-18
acatttcaaatcggttagttcgtcgacaaggaagctggcgctgacataatcgacgattgacagtctacagtgcggcgtgaccgcgaagagtcggttaaagtgtgtttagtgagcacaattcccgccagatggcccagtacttggaggaccaccacaacatgatgtaccaaagcaagcccctgaacatggataccaaaataccagaaaacaaaccttcgttttgcattgacgcgcttctatcgagaaccacagacagaccgacgtcacccgatacctcccgaagcatctctccgacctccacgaggagtaggagcccccctatttctccggggagcgaggacgtgcctcccacaaccttcgtgcccaggccggggctcctgaaccacatttatcctaacgggggagggttctacgggtaccaagggcagactcaaggttctgcgttccattctttggatgccggaatggtgcagaaggttcacctgcctgtaggcccccacaatcagagccatctgcaccagatgcagctggagtggttcgcgaggacgggaatgttctatccgaggttgccagatctttcaggttgtggtccaggtcacgcccttcttggcaagacaagaagacccaggacagcctttacctctcagcagctcctggaactggagaaacaattcagacaaaacaagtacctctctaggccaaagcgattcgaggttgctacgaatcttatgttgactgaaactcaagtgaaaatatggttccaaaaccgcagaatgaagtggaagcgaagcaaaaaagcccaccaagaagccaaatcctccaaagaatctgattccagcaaatcacaaaccgtcttgaactcacctccaagcaactacaaatcgtgtccttcaatatctagtccggaaagcacggaaagtccagtgcccatcgaaaccaaccaagaagttcggaaaattcaagaaagtgaaactctttacagaccttacgttgtttaaaatgacttggactacagatctagtgtgttttgctcaagtcgcgggatgtgttcctcggatgactagacttctccaacacatccaaatctcgagaatcattcaaatatcacacagcttttagattttcatggcagctgatttgaatgccatctcagtgatgaagcagactcgggaatagatttttaagctgatgaatccagataccaacgaaacagtattgatctaacatcaatgtccaataagactgcatctaatgagatcaatagtaggtcaaaacagcgccctctggtcttggatcactaaggtttccttggaatatgggtttcacctgcctggtgaaagctgcccatgtagtagatggcctctttagttaacgaaaaaagaatctgatatctaaacaaaaatagatgttgataacttgtatggtgtctaatcattgtccgaaatgaaatagctgaaaatgtttgaacgtcgtcattttatgcacaatgcaattcgctcattaaagttgttcccatatacctgaatactaaaccgaccgtcagactctccagtaatggtgagtaaaggcgcaggaagataaccagtaattagaaagaaagtgtgtttttgcattccatactcttcacagttcattgttctcaaggaatattcaactaaaaaagtcgtcagaccttgatctgcgggtggattgttcgtcagtcacgcgtagtaacataatcctgaattttgaaaacaggtaatagtatgcagtctgaatttttttagttgacagtgtgtagcatgaaaagtacaaaaataatcgtcagacgttatggaaatagtggaaaacccgtcagtcgggcaatctaagtggatctcagctctgggaaagaatcaagcgcgcggcatcttttgcggtcccactgacggactttccaccacgttcatgtcgtctggcgatttattttttatactcaaaaaactatctctgaaaaaaaaggtctcacgacttttttagctgaatataccttaagaatggtgaactgtgaaaattatggagtgcagaaaatcactttcttttttaattagtggttgtcttccgcagcttcctccgatctctacctactaaggtcgcctatctgacgctcggtattccgtaacataaacactactttatagattgagttgcattgtgcataaaatgactcataaaaaagtgacactggctcctggactattagttcattcgattcggatactcataaattggaataggtgcgttgagatttggctacagaatattctgaaattagttgtcttgggatttggatgttttgatatttggatgacaaattatcctagaaaagcagcttggtttttcattggatgtgaacattaataaatccattggtgcataaaggatttgctaacaagaaatgacagacactttggcttctcccttttttgaacgggatattccagaaaattgacagtcgtcttgatttccgcaacatttgtagaatattttgtaatatat

SEQ ID NO: 170 - DNA, 1975 bp, Leptinotarsa decemlineata
  Annotation=ADP-ribosylation factor-like protein 8B; Tribolium gene name from OrthoDB database=TC012677; Blast E-value Tribolium Gene vs. Leptinotarsa Unigene=6E-126
gtctgcgagtctgcggtcaagtgagaattgtgacgaatcttcaactttgacacttgtcaagtgttgaaaacaaattgggtgtcaattttggttctgtttattaaattttattaaaggtcctcaaagatcaaataaaacattccaagatgatagcattaatgaacagaatattagattggtttaaaagtttattctggaaagaggaaatggaactcacattggttggtcttcaatattcaggaaaaacaacctttgtcaatgtaattgcttctggacagtttagcgaagatatgatacctacagtaggtttcaacatgagaaaaattaccaaaggaaatgtaacaatcaaagtgtgggacattgggggccaaccgagattcagatcaatgtgggaacgatactgcagaggagtcaatgctattgtatatatggtagacgcagccgattcagaaaaaatcgaggcttcaagaaatgaactccacaatttattggagaaaccacaactagctggtataccagtcttagtgttgggtaataaaagggacaaaccacaggctttagatgaaaacggccttatagaaagaatgaatctctctgcaatccaagatcgtgaaatatgttgttactccatttcatgtaaagaaaaagataacattgatataacacttcagtggttaatcgcacactctaaatctggaatgcgctaaacaaattaagtaggtattattttaattgcgataaactaacactacttgcgaaagtaaacatattttcgaaactgttcagtctttacaaaagatctctttgtcaaatatattatctaggatttttgctaaaaataatgtttgggtactaaatgtgtctgtaaaaaagaagatacttattagtagttttcattttctttagtatatcacttaacaaatatagcggtacttttctgagataaatacctcataaacaaattgcgtggtaaaaaaaactttgaaattttgttatatcctttgtgtttctaggattctcctaaaaaatagtgggtgtgtaatgaattacttcatcttttatgaaatcaaagtcagatccacaataaataatggtagtatcatctgcaagtagttcagttgatcctttcaacttcaacaatgaaatagaattaatatacataaaaaataatgaggtcccaatactgatccctgtggactccatgtgttaaaatatccatttcaatttaaccattgtgtttaatttcgacagtgactgatacactatcaaattttttcagtagaattgaatagtcaacattgtcgaaagttttacagaaaaagagttgtgaatttaaaaataatctttagttttttcattagttcatttaaatttgtcgagtaggaatatttattttggaggttattggaatagacagtgttgagcttgaacatttctgactgaactaagactgtagaaaaatatgttcactttgaactagttttcgtttttcattctgatccgattttagaggctgttctccaaccatcgctagtcgaatcaagatttaaagcgaagactgttttagcatatattcacttgctgatatagattgtaagttactataaatttatctatatgaaaattacgatgctggttttataatacgttggacgttgaaaatgtaaaaaaaaataaagtgaaatatttgttgcttcagtagactcggaaaattcagaataagtagaaaagtaagggtagcatgatttttttgtgtaattattgaatttatttatatggtttactgatatgtacagtgagatttttttatatacacacatatagatattcgaatagttttatttccagatttagttttgtattgaatgttttaactttattgtcttatttccttcatactgtttacattaggaagtattatagaaacattgatatgagattattgtcctttttgaaataaactacatgaaaaacg

SEQ ID NO: 171 - DNA, 1660 bp, Leptinotarsa decemlineata
  Annotation=Insulin-like growth factor-binding protein complex acid labile chain; Tribolium gene name from OrthoDB database= TC001743; Blast E-value Tribolium Gene vs. Leptinotarsa Unigene= 1E-25
tatatatatatatggtaggtatattgaaactttctaggtttgaattcttttcttcactaatgaaatattcctacaccagaactaaagcactgtatcttgacatgagtttcgctaaccaattagtaacatcagaagatgacttagtcatttcctagattcattttttgccagagattccagttctatctgatataataatgaggaaatgatcaatgaaaaaagaaaaatagcatcaataaataacgagtcaataggtagctatttttttaataataacccaagtcctcttgaccataaatagagatgacctcgaaaagaaatttcaaattacaagaaagcagttgaaattatattgaatataagaaatattttggaataggtttcagtgtgacctgaaaaaaaaatcattgggtcctattaataatataataaaattatttctatgtgttatctaactataagcgcaataacagtaatgtaaatacaattttgcttctcacttaaaaatactgtgcaagcattaatcagaattttaatgatcacctatatatgactgaagcttttactcattaaacaccatcagaataaaaatgtttccgtcagttaattaaaaacaataatggtggtcggcgtctacatatattactattctttataataaatagatcaaaacctggctcggatatatttacaaaaagtaacgtttaaaagccaagcgctgtgaaatatttcatccaaaattattcttgaggactggaagaatgcacagttggaaccgaagtgaaatcatagcgactcaacttcggagttttaggacctgaaaggtcctccgacagcggtctatagatagacccgctgtgtttcttctgaccaggagtggtattccacaagggaatcttcagccttggaaggttcgctttttgcatgttgaagttgttgtttcttcggagtatgcacaaggtcacggtaacagcaactgtaagaaccaccacagcactgagaacgaaagctagtgcaacagcgagcatatacgaatctccagtcaacgaattatttccgccttctagcaggtaagtatcaccagcggcagggctgaacttgtccaaatcatccgaatctatatcctcgccatcgtcttcataattgtagtcgtagttgtatgaatcatcgtcatcctctgaggtgttttcaattttcgaatccatgctgctaacctcaatttctttaggaatatatttggtggttacttcgggacaagtattgtgatggaaatccttccagtcaatagtactgaatccgtcaatgtcttctccataggttttttcaaagctgttgaagaaatccttggtatactcaatgggcgagaccccattcaattccagtctgtgtatgacactgcaaagtttgtcgtcgaaaattaggggattatcattaagatcgatagcttccaaaaaaggcataatatctaagtcatccttggtaagagttcccagctgatttcctccaagcaataacttgtgtagagacttaactggtttgttagtgttggaccagagtttggttagagaagcgtttctggcatcaatttctctgagaactctgttgtagtagaacacctcaggattgagtaccttcaacggatttccagccaggtgtagat

SEQ ID NO: 172 - DNA, 1783 bp, Leptinotarsa decemlineata
  Annotation=AND1/Ctf4; Tribolium gene name from OrthoDB database= TC012023; Blast E-value Tribolium Gene vs. Leptinotarsa Unigene= 0
atccagtttcctttgtttctccttttgtttgtcagtctcagaatcggaattttttcgtttctcgccagtctctccatttttaactttattctctttggtttccttttcataggataatccagcatatttatcagttaaactgagtggattagggtctttggcaactttggattttttcaaactcttcaaaaatggattcggtttcacttcatcacgaaacaaagattcttgtgtattcacagaagactcgttaagagtagtattatttgttgcaggacctggcgttgatatttctgtttcctgggaagtttgcgatacatctggggtatttgatacctgcttcagcctatccagtttatttttgggggtattttttgaaacactcaaactcagttttctataaaccggtttcatttttggctcttcttccattggaatttctttcactcccaaatcttcggtatcgtctgcgatttttgttgccaaatccattagtttttcaactagacgtcttctatccagtttagaggcgtatttcaaactcagcgctatcagttgcggattagataaaacatccataaactccaacgctctttcatctaaattatttcgacaagctaatgcgaatgttttcatagccgtttccttaaacttcttatcaacatctgaaacctgcaatgtagaccacgtgaacaaattcatttccatttgtgttttttcagtcatagactctgcgaaaggtggttctaatggtatctcgcacatagtcggtcttggcgtgaagctaggatagatggaacctttgcattttatacctcctacggcctgatatgattcaaaaactgccgttacaaagaaaccgtcagccagaccttttctatgtttggaagtatcgcaaaacggaatccacatattgctagtatgcgggtagagagacagcatgcccaaggaatccatcatggcgggagtaccgacatcagaaaaacccagccacagcaacgtcgactctgggcctagtgcagagccgagatctttgcaatccactgaagtgccttcgaacctgacaagcctgatattgatacactggtccccattcctcactcccgaattgtgatacgctatcatgagagagtttgcgaaagcagacattgatactatcggaccagggaccgatatcacggctctttgcgtaccgtaaaccaaggaaattctgacgaggtaatttgccatggcgaaacagatgagattctcagaagctgccactagaattatttcttccgtatcttctaccttcagattccattctttggagctcgcagctaagggtatcacattgatctgactagaatttccaacaacaagggctgctttactcagagatgccatcgtgtattcctgataattttgcatcatcatgctgttatgaaaggtggaatcgtgaaactcgacttcaatcgactttgagctagattcatctccattatttccgtaacacctgatgatgcctacgtgattccagcaaagataacgaggatccaagtggtccggagtggatgatggcataaagggcggctgcagtggaatttcgggagtacatggtctcggcgatggtgcatgagacgactcagtttccagtttcttcaattcatcatctgaatctcccatgtattgcttcttgagtttttcaacagaaacaacattttcattatcttcgtcgtcatcttcttcaaactggataccagtaaaatcaacatcattgtctgcgaagcatcatcttcagctg

SEQ ID NO: 173 - DNA, 4137 bp, Leptinotarsa decemlineata
  Annotation=Protein FAM40A; Tribolium gene name from OrthoDB database=TC010759; Blast E-value Tribolium Gene vs. Leptinotarsa Unigene=0
gataattcatggtggtaataaaacttgaagttttaatgggtggttaaaatctgatttttgtgcggttcccacgtaatgacgatttaaatatgctggtatatccaggatggacccaaatggcaatggaaagcgaggtttgcccaagcttcgggaaattatccaacgtcagtggcacaattccaatggggacggtgcagactctccagacctggaattcatctacaatgataccgatagtcacattaacgaaatcgcagaactttatagctatacggaacagccagaactgcaacttaatgtcaaagcgtttgaagaccaaatggaaacgttcagtttaccacccagttggcagaaactgtcttctgaaaagagaaagtcggtagttttgaaactgcttgatcaactagaagttaccagcaaaccattgagaatgcggagtgctagatgtttactctacatctcacaagggtgttgggctgaagtgcagtcagatgcagaacaacaggaatgggccaagtgtaattcaatgttgctgtatcgactaggtgtgttcacggccttcaccgatctcctgaatatcgaatttgaaaacagcacggcagcacatgtggcgatgagaaaaattgcaatttccttggctgattcacaggatttgcgagtcattctgtctgttttgtatacaataacagaagtgataagaaatgagaaggattctaattcaactgaatatcgggaggaagttgattctttttgcaaagaaatagcatactcttccacagatgacttactagttgtgaaactcctaagtatggtaacaagattctgtagtggatcagctccacattttcccatgaagaaagttttattgctactatggaaactcatactggtttctttagggggcatggcaactctaaaggaattgaaaattgaaaaacgaaccaaggctgaactatcaccccaagttgaagacacaatggagatcgcaaaaacaatgaggtcttcatcaccacctgctagcgcatccgatcttcttgaagcccaaaatcagaagagaaatgccaagccattcagaaggagcctgatgaagcagagtagtttagatgatcaagattcaatgggaattgaactcgactctaccattactggagaaaataatgacgaagaactttctgagtatgacgagcgtagacctgcgaatgaacccaatgaccagatttaccgaaacaatgtagatacttataggcctatatcaccacctaccccaaatgctctgattattcccagaggattaccttggaaacccaaggtgcgtcagaaagacatcgacatattcttagataatgctagactcaagtttttgggttatagtcttcctggcgatagaactactttgtttggtttgcctgaacctattcatgaaggagtgaagactcttaaggagcatatttacacttctctgtcggaactccaaattcaaaaggaggaggagatagctcgaaatccaatttctataagtgaaggtgaaatcgaaatgactccatcggaaatactctaccaagcaatgctgccaaacctgccacaatatatgattgctttattgaagattttattagctgccgcacccacctcaaaagccaaaacggattcaataaacattatggcagatgttttaccggaagaaatgcctatgaccgttttgcagtctatgaaacttggtatcgatgtcaacagacacaaggaaattatagtgaaggctgtcagcgccattttattgttgttgttgaaacatttcaagttgaatcacatctaccagttcgagttcatgtcgcagcacttggtatttgccaactgtataccgcttgttttgaaatttttcaatcagaatattatggcctacgttggagctaaaaacgctattccaattctggatttcccttcttgtgttattggcgatcagccagaactcacatcagaaagccttgaaatcggagattccaccacgttctcttggagaaacatgttctcttgtataaatttactcaggatattgaataagttgactaagtggaagcattctcgaattatgatgcttgtcgtattcaagtctgccccaatcttgaaacgtacactgaaagtcaggcacgccatgactcaactgtatgtattgaagcttctcaaaatgcagaccaaatatttgggaaggcaatggagaaaatccaatatgaagacaataagcgccatctaccaaaaagtcaggcatcgcctcaacgatgactgggcctttggaaatgatttagatgccaggccttgggatttccaagcagaagagtgtgctcttagggcgtctgtggatagattcaataaccgtagatatactcaagtgaatgatagtgattttgaaccagtagacaattgtctgaatagtgtcctaggaaccagccatgacctttctgaaagctttaaaaaacactaccatctatggttggagcaggaagtgtttggtgtcccaatagaatgggacaacttattagaaaatgttaattgaacatactcagaagtgatttttgcaataaaataccccaacttgtacatgcaataaacaaattaggatgtattaatatgtagatatatacgtaacggcggtattttattgcataaatcgtttagcaattatatttatactgaaaatgaaacatattaagctagttttcaaatgcaccttgtttcatgaccttttttgcatatagagtgaaatgctaagtttatttgattgcatccagactcttgggcaagtatacattatactttttaattgaggaaaacaaactttcataaaacggcaagaagtttctaacacgaaatattgccagacgcaaaatattttgtataattgcagcactgaataactttcagtcagtccaaacggggatttcgctcttttaggtgggtctggagacatcgttatcttcagtcttctaaacgaacaatgttctagattaacaagaactgaaacaataataatgttattgacaatatttaaatttattagagtttgttttccatatattttttaaggttttttattcaaataaatttcactaggggcctataataatcggaaagcgttagatctgtactcatacattttttgctatggaaatttttaagtgtctatactcttgcattataacagaactacctcagatgaaagtattcacttttctaaagttttgtaagaggtatagtacaagagaaaccagatgttttctgtttgtgaatttttatgacatattttttcacttcaggggtgaagaactattttaggtgatcatttggagggtgatccataaaatgttttctcttattgtattatgctaaatgccattttggattgtcaacgactgaagtgtcgtaatttgatgatatactttatgtgttctcatactcatattattattactggtaggtagttcagtagcaggtgttgagttgctgtgggacaatgaacttttggcataggcatagagaagtaatttcccgtcttggtatttgattcttctccattgagtttgctcattcgcctttggtattcttgaaacggaccgtattcttcaggtattctcattgatgcaaaataattgcaatcaactggttcaggatgtctagccaatggaagtgacttggtacaccgataggccaataaggtaggactatcatttgcagagaaattaggtggagacggatgatatccaaatctaagtgatgattcagcatgacatctcgtaatgaaatgtgcattacattgacataaaggtctgtacaggcctctcgaagctgaatcttatgcaattccacacatgaaatggtctgtactctggtctcagttcctgtttattatcaatatccaattgatttcctaaaactagtggaactttcgaaatcctcggttttctgctctgttagtgtaactcctgcacatgatgacgtctacgaagtttttcaccccgtttcttaaggaggaaatattttctgatgaaataatgtttttttttcaattgagctgaaaaactactttatactcggttattgcctgtagatatgtaaattattttttgcaatatacttttcaaacct

SEQ ID NO: 174 - DNA, 2355 bp, Leptinotarsa decemlineata
  Annotation=Zinc transporter 1; Tribolium gene name from OrthoDB database=TC015914; Blast E-value Tribolium Gene vs. Leptinotarsa Unigene=5E-1; Blast E-value Tribolium Gene vs. Leptinotarsa Unigene=0
cattggccagtccatgaaatgatgtcatttggatactgtgattcagtgttgttcatttctgttttcagttattgacattgttatttgtcattgtatgtattgttcacatcatttaactatagtacgatataacgatcctttattttctgttgattgatggtgtgaaaaagttcatgtctttgttagtgtttaggaatactagtggtaaatgtaacaaacgttccatttttgaattcttcaccaactcatagtagtgcccttcgaagcatctttgttgctaaaaataggtgattatattttttcaattcattgtggagacatttgggacataatctattttaagagcacataaccattgttcagtgaattcaaatgtgagagagaataatgattggaatataagtagtgatattaattgacattttgaaactaatggagtatggaaaatattactgactgaaagaaaggcagagaggtttgaaacttcacctgttggacagtttggaagtaaattcaaaaactctcaatatcttatgtacaatcaaacagaactgaataattcgccattactgaatctgtttatttccagttgatatgggaaaatttactggcaaaaaatgtcgtttgctgtcgatgttatggttgactgcgctgttcttcttcgtggaaatagtcgtaggctacatcacaaattctatggctctagtggcagacagctttcacatgctgagtgatgtagcagcattagttgtagcctttttatccgttaaaatgtcaccaaagaaatgggcgaaaaatacatttggttgggctagggccgaagtattaggtgccctagtgaatgctgtattcctcgtggccctatgcttttcaattaccgtagaagcatgtaagagattcatcgaggtggaaaccatccacgatcctcaattgctcgttattgtaggaggagttggacttctagtcaaccttataggactattattatttcatgaacatggaagttcgcatggacactcccatggtcgcctctctcacagtcggaataggttgactcaactagctattactgacgataatgaaaatgatgaaacctaccctattccaacacttcaacccgcgacaggaaaagagatgggacatactcattctgcaggtcagatgaatatgcgtggggtatttctccatgttatgtcagatgctttaggatctgttattgtaataatatcagctctggttttttggctaactgactgggaatacaaatactacatcgatccagctctgagtattctgttggtattactcattcttaactcagtctggcctctactcagagattctgctttaattttattgcaaactgtgccaactcacataaaagttgacgctatccaaaacagactgttggctaaagtcgatggagtgcttgctgttcatgaatttcatgtttggcagttggcaggagacagaataattgcttctgcccacattaggtgccgcaatctctctgaatatatgaaaattgctgagaaagtgaaagaatttttccacaatgaaggaatccattcaactacaattcaaccagagttcatagactatacagatatcccaactacttctagagcacctgttgaaacgacagaggattgtgtgttggattgccctaaaacaaacaacacaaatgacaactgtgttaaaaatacttgctgtgggccttccaaacagggccgagatactccgtctccaagcaacaccccctatatttgtcgccaaaggaattctgcagccagcacatctttgaataatttagaaatgaatgaaatggaaaaaggcgttcttctggaaaaggggacatcacccctacaaaatgaatgtgaatgcagcttacgtggctcccagtactctctcaggggttgataaatcaagttttggttgaattttttttgttttcaaggtattcagctttggttcttgtctgctacggatttcagaatttttatgtagcaaataatacagtggaaactaccttgaatggccccttcattatattgagtgtaatattttcgtatgtgttaataaacaggatggactgtaccgaagtacacaagtaccagggctgtacaaattggggtgttctagaatggcttcataatttattataaacattttgtatatttcatttgaaattgaaaattttattgacacaactattcatatgttattttgatgattgagcatttttcaaacaagtgttgaaaatatattaaaaaaaacgatttgattaaacgaattttaaaaaataaaaaaaaaaaaaaaaaaaaaaagtaaactactagacgttagataaccact

SEQ ID NO: 175 - DNA, 4614 bp, Leptinotarsa decemlineata
  Annotation=Sodium-and chloride-dependent GABA transporter ine; Tribolium gene name from OrthoDB database=TC009753; Blast E- value Tribolium Gene vs. Leptinotarsa Unigene=5E-1; Blast E- value Tribolium Gene vs. Leptinotarsa Unigene=04
ggggactttcaatttacaacaaatagtaagtagtagtatcgagccattcacgacggagtgagcgttcgcgactcggtttacattccaaaagaacgatgtgcgcgaattttttaatcaaacgtagtttataactctgttttatcgctactggtatgataatgctggaagatatgccaaggagaagtcacactgtgcaaacagttgcgtaagggaaggcggtaatcatcacataatggaacattcaacgaatatgccgccccacagaaacggcaaaacggatgaagctggtttagtaatgaaggaaatcaagccgggaaattctatgatcaaaaaaatgttgaatagtgaggttggcgtaattccagcagtagacgaaatggatgaaaacgactgtgatatagaaactaaagataatatcgtactagagcataggatttcacctgtaggttccttgagaaagacttcgaaaacgggccactattcggcaataccaacccaaagttttaactcaatatcatcccatcagagcagtccaaatttccgtaggaacaacagcgtgaggtctctgagaaattatcatcatctgatgggagatttgggacataaaccacctagtagtgagtccggaagtcacgtttcgaagcagccatccgacacagtttctctaaggtcatgggcatctgtgggtatggggtctactgatgggaaaaagatgattgttaggagggtacctacttcacctacggaactcttcaatatcgttaatccaccaactccacctgaggagtacacatatggagaagaaacagacgatggaagtgaggaaggtgaagacagtgagtacaataaaccaagaagacaacactggtccaataaacttcaatttgtactcgcctgtgttggatatagtgttggtcttggatcaatttggagatttccgtatctttgctacaaaagtggaggagctgtgtttctaattccttatgccatcatcatggtgttcataggagggccaatgctgtatatggagttagctgtaggacaattcacaggcaggggaccaattggcgctctgggccatctctgtcctttgttgaaaggtactggacttgggagcgtggtgatatcattcctcatatcaacctattacagtgtgattatcgcttatggtgtatactattttttcacctcatttcgagcgaaacagccttgggaagactgccataatagatggaatacgaaattctgttgggttccgagtgtcaatcatactaaaccccattatagtcaatcaccagctgaggaattctatgatcggaaagttctccaaataggtaaaggaatagaagatgtgaattttctgcgatgggaattggttgcttgcctcatctgcgcctggattttgatttactttgctatatggaaaagtattaaatcatcagctaaagttcgatatttcacttcaacatttccattcgtaatcattgtcattttactgataaaatctttaacgctggaaggagctgatttgggaatgcgttatttcttcaaaccgaaatttgagttacttctagacgccaaggtgtgggtgaatgctgctagccagacattcaactctatgggttgtgcattcggatcgatgatatgttttgcaagttacaacaagtacaacaacaccattttgcacgacaccatagcagtgtggctagtcaatgggataacaagtttgatcgttggcatattcgcctttgctactataggaaacatagcaacggaacagggtacctcaattgaagatgtgattgatgatggtcctggattgattttcgtggtctacccacaagcaatggccaaaatgccggcctctcaactttgggctgttatatttttctttatgttgatatgcctctctttgaacagccaattcgcaataatcgaagttgtggtaacagcaattcaagatgggttttctggatggataaagaagaatttaatgtgccatgaaattctcgttctgatcatatgcgttgtttctcttatttgcggacttcctaatgtaacagagggaggaatctacgtatttcaattgattgaccactatgctgccacaatctccataatgtatcttgccttttttgaagtgattgccatttcctggatttatggcgctcgaagactaagtcagaatgtaaaaacaatgactgggaggcatcccggaaaattcgtaatgttctgctggacgatcgcaactccattgatgatattagctttatggatttttctgatagtagattatgaacctcctacttacaacaacggggtataccactatcctggatgggcaattgctattggctggattgtcgcctcaatttctatattctgtataccaatttatatggtggccgtattcttgagagctcctggatcaaatcttcttgagaaactgaagaattcgatcaaatcggacattgtagaaagatgtcctaaatgtgacgaaacagattgtgattgcttcctgaaagatgaagaaatggaacaaatgcttgttatgcgtccaactggtgatgtactcacaggcgataactccgtacctctaacagcactttttcctgtggccagttctccaaatctacaggcgaaagatgcagctcaaatcaataaccacgaagaaacgttcagtcaatacgataatgtgaatggaattaggagtaacgagatgtaaaataactagaaatataatctttcttttctctccaaatcaataaaaatgcctgtttcacattcttattctagataatatcattttcatgaatgtcgaggtattcatctgttgattgtgtttctggtatatatcagtcaaataatatatcacttcactatagggtactatatatattgcgggaatagcaaataataacaaacatttttcaatgaaaatagctttgatgtttttcgaagtattctccctgattatatcaatacactgttgcattcgttcaaaccatttgtcgaagcagttttttcatacctcttgagacacctccaaaacatggtttctgaacgcttcaactgcttcttcagcgcaatttacctttgatattcgggaacaggaatgagttattgggtgccgaatcagaactattaggaggatgagtcatcaattcgatgtttcggctgctcaaaaattcaggtgtttgacgagatgtgtgtgagagctcgcattgtcatgatgaaaatgattcgtctccggcggttagtttcacgaatttttccgaagactttcggcaaacaaatggttgtgtatcactcaaaaatgacccttctacgttgctcaagcagaacagtggttacatgactcattcggctgaagaaacaggtgaccatttgctttgctgtgcttcttctacgaactacattcgttgaatttagctagtcttgctcggtcgattgctgttttgtttccagctcatgggtatacatccataattcgtcacctgtcacgatttcatacgcgtcttttgaagcaacacagtcaaacttttcaatcaatttcttagaccacttcactcgagccttgttttcaagccattgataaattatagggtctcctacgaagacaaattatttttacaattgagagttcatgcaaaatcgaatgtattgaggtagaactaatgtgtaagggtgcctcaatctcacattatgtcacatgatgatcttgcattatcagtgcacgtaaaacatcgactttttttggcacaacaatcgattttgaacaatcttcacggaattcgtcgacaactgaactacgactacgattgaattcagtacaccaacgatatactgtgttttagatggtgctttatcgcaatataaatgaaccttctcttcaaatttacatttttaggtcgaattgatttatttaacaaaaaaaattgcacacatcaaaacgttgcgagtacgtttgtgctgaaaataaacttcatcattgtgttaccaaattttatttattgacattagttttgccagttcccgaaatataaatagtctccaattgtacctcgttcagctcaaacataagtttctttgaatacaaatactcgagtcctcaaaactcaagaccgatttcagagtagctgataatttttatgtaaaatgtttatatcacaactctatttcaatacagtcttccacctcaccactgtcaatgacaacatcatttattgtcagaaaatagatgaaatgaacaatcggctccttgagcttattgtttcacatcatggtgataaaaaaattagattttttggtcgaggtgaggtcattgagtcacatagaatatgaattatttgaaatatttcttcaaccagcaaaaaaatcacttgtcagatcagttatttcagtcaactcgtcagttcattccattcctgtgaacaaaaactttgtttggtatcagaagaaggtgatttttttttattttggttcattttcatctactatccagttgatggttgatttcatcgaaaaaactgaaatcattccaaatattgtgattgattttatctgtgcatatgtttcatgatattaaaattttctttccaaatcgtgtattcc

SEQ ID NO: 176 - DNA, 6544 bp, Leptinotarsa decemlineata
  Annotation=Ras GTPase-activating protein-binding protein 2; Tribolium gene name from OrthoDB database=TC000929; Blast E- value Tribolium Gene vs. Leptinotarsa Unigene=2E-1; Blast E- value Tribolium Gene vs. Leptinotarsa Unigene=05
gaggctcccccttcaccccaaagtgttggacgagagtttgtgaggcagtactatacactgctgaacaaagctcctacccatcttcatagattctacaaccaccaatcgtcgttcgtccatggggggctggaccctcccaaccgcgagacgagccccgtgatcggccagaagcagatccatcagaagattcagcagctgaacttccgcgactgtcacgccaagatcacgcaggtcgactcgcaggcgacgctcggcaatggcgtcgtcgtgcaggtcacgggcgagctctctaacgccggtcaaccaatgcgccgcttcacgcagacgttcgtcctggccgcgcagtcgcccaagaagtactacgtgcacaacgacatctttcgctatcaggacgagatcatctccgatgaagattgcgagccagacgggcattccgagacggaggaggacgtttcgcctgggcaagtcatggtggaagttccacaaccaatcaatccaccagctgtccagccttactacaaccccaacgccgctcagattcagcctaacatcccggccgttcccattcatcacaatcagcaaccaccaccgcatgttatgaacccccaaccggtcccaactgtcaacggagctattcatcctgatgaaatcaatgttatgcaaggacaagtcccgcctcatgttcccaccgttcagcctcaaggactcgtttctcccatgccgactatgcaaccgtcaatgatccagcctcctttgaacccaccggctccaattgaagaattacagcaaccccaagccattgaagatccgatcgaggagccattggagagtgcctatgttgtcgagcaacaggaaattgtaccggaaccagatatgacagtgaatgagtctgcttctaacgagcctaagacctatgccaatctactgaaatccggcagcaccataccttttggaagtcctccgtctcaggctccttcaggacccgcgcccgtcgcacagccagctgccgctagatcagtgtctcctccctcttccggaggttatcagaatgtaggacctcgctctaacaacaacggcaacaatatgaacaatcgaggaggtcctagaccgaatcaacagccaagaatgcagaacagacaagactccggaagaaactcaatgggtggcggcggaaggaattccatcaatgaggaaggaccttatgaagatagacgtcgttcccaaagtcaaaacttcaacgatgttaaccagctgtttttgggcaatttaccgcatatggcgactgaagacgagcttcgtgacattttcagcgagtttggagtcattgtggatctaagagtgcacagcaaaccgccaaataagatcggaggtgcgcctggtggacgggccccaccaaactacggattcatcacgtatgagactcagcaaggtgtgcagagttgtctacaagccaagcccattttctatccaaaagatgacaagaatggtacaccattgaacgtcgaagagaagaagacgaaggatagggaacgtctcccttatggtggcggtcgcccgatggataacaggggcaggggagacaacggtgggccgagacgcggaatgggcggtcccggaggccccaacaggaacagcaacggaggaggtggcccccccggccaaaacaacaggaacaacacttacaacaacagaaacaacggcggaccacctaaccgcggctccaacccctacaaccgccgctaacctcaatgtttctcccgtcgtctgactgggtgacggacgttgccgcgtcactctagtttgtgtgtaagaaaagcgtatgtgggtcgtgtacagtgtattcgctaggctgagatatatgcgagagctgttacttgttagtgccaacggcggaggacgaacagttgcgggttatttacttcaaaccattgtttttttttcgtttggttagttttttttcaatgactcatccacagtaccgttgctctacattctatctgccagtctcccaaactgatagtcatttctttttttatttgtaactccgaagtacttattggctgtgttgtatgataattttgcggattggtgaatagcaagacgaattagaagaatgttcagcaattgaagaacgaggtataccatgacaggtaatccactactggacatggtttgaattgaaggacagtgtcacagctcgtcagccgcgcaggtcgtactttgtattaattacatacctgttattttatatatcgcaagtagtatttatgtatcattattcagactagattcttacataaaaacgaatacacgctttaatttctctgttcattaactgtgtgcggagttttcgagtaacatcatgctccgtttgcaatttgtcaggaaacgtttttattcgatataggatttgtttagtttcgctgtatgaataattttcagggttgtcgttaagatgttttgttcaacaggttgaatataattcacatattcggacataaatagccccttctctttagcagtccaatatatcgaagtcagacaaaatgtatgtaaaaaggtataatttcaagtacttttttgatcggaattagtgttgcattacctgccgccgagagggcgctacaatattttttaaattaattgtaaagggggatttcagttgatagttatatcaattctctatacaacactttcatttttggaaattgtatcgtctatttctaaataattaacagtttttaatttgttttaagaatctgcaaacaaatgatgaatataatttaaaaaaatgtattcatataatgttagaaactcgtgcattattattctgagagtacactttatattccatatttcaactcctatttcgggcaattcataaattacaataaattgatggatgtagccgttactacgtggtaggaaatcatactaagaaaagagaattgaaactttctgtgttttgtaccaattttatttgtaactaacgttactgcagtttcctcctatgaggacattttcaaacgtatacatttaaatgtatacattaatgtataggtttgaaaatgtccttatagaacagaaaactgcagtacgttagttatacattagtacaaataaaaatgtaactaactgcagtaactaacgttactgcctataaggacattttcaaacctatacattaatgtatacatttaataaggacattttcaaacgtatacattgaatgtatacattaatgtgtaagtttgaaaatgtccttataggacagaaaactgcagtaacgttagtttcaaataaacgtgtaactaactgcagtaactaacattactgcagtttcgtcctatgaggacatgttcaaacttatacattacatgtatacattaatgtatcagtttgaaaatgtcctcataggacgaaaccgcaataacgttagttacaaataaaagtggtgaaaaccatagaaagtttcaattctcttttcttcatcatgaattacatcttgcagatcattagacaaccattcccaatttgagataaaatttataattatgatataaaatttacttgtgaaatgcctgcagctgtgaaaacaactattctgtagtataaaagaattcaaacaccttagaagttttacactaaacatcaaactgtcaaaaatatcgggtagataggagcaagagttcacatacaagttagtttattttttttgttctcaagatatttctcctttaatcacttataaattttgatataaatgaatagatttttattagattttataaatgttcatctgaaaaattgcaaatggaagtggtggtcacgcgtggatgatgggaatggaaacatttgtgaagcttcatgtgtcttgaactacaattttgcaaatgttacatttcaaatgaaaaatttgtaatggaaaagatttatttatttcacaaagaaattatttttgacaactttatctttactctatagctttaccatcatttgctgttttaccttgaggcagtgaaaacatcgtgtacaaaatttattttacattcttgcattggttggtactgtatacttgtttttatactttgattattattaggatcattttactcttcatttagtaacggatcattgaaacaattggaattagtaatttcagtgagctttacagatatttttttgtttgacagcttaaccagtttttgttaaacttgatgagtcttccacattatgggatgcccttgtcttacaatcccatggaattattacttctcaaatgcactctaataatgtagatatattttttctgtacaatgttacggaagtgttgaaccctgaatcagttcaactcttgcaatgtagtctgaccctatgatgcacaaatgacaaacagaagcagcagtataagtggatgattggcccagaactgcactgggtttattcagtagtaatatacaagctttgaccagacagagttgtttaattgctgtgctatatagcagaatggttttctatttttgaattggttccaactcctgtatcattgtaagagattgtcccttgtggtacggtttcattttcgcattttttactgttttcaactttgaaaaatgtggatatgaatcagtttcagaaatcacataataccttgttaacattggcatcagactgaatcaaagcttggaaatccggtctgccaattgcagcacatcaatagaccatattgggtaactactttatttggggcgcatgtatttttttgtgttggctattctgtcagttgtcggatgtacttgatgttttagggaagaatttccaccaatgatggcactagtcaaatagttaacagatgatcggaataactgaatgttgaacataggttatgttaatcgttttggtgtttttttgtgttattagttaactaattgtgaatttgtgagctgttttttaatgctttgatatgaactgttttcactcaaggaaagcacaagaaaccacatcaaaatatgaaaacagctgacaggactgccagtttttgagttttgtttgctgttttcatttttgatagttttttcaatagttaataataatattttgagtaattgacatgacaaatgacgctaatgacaaatatacagagaagccgattgaaaacaaattcatgctctccaaatgaaatcttatcagctagaaaattacggtacagtattcaatccacgaactcaattgccgaacatgtcttatgtcatttgtgagaatactctttcctccgtgaacaaaattaatccatgatatcggcaacatacaggtatagatacagatgtaccttgatgatattgtgtatcaattttttgttgaacctaggggttgctttcgtctgccatttgcacattttgttaatcaaactacattgcataagttgtaaattgttttcactgtagattgctttaatgatgactaaagttactattagtactacagtataacatggtttcaaaatattaggttttcatttatatatgaaccgggctgattgaaatatgagtagattagaatggagcaacgtaacacgaatgtttcactgcataatacttcgcaaatttggttgtaaatatgtgacacttgaaaactgatctggagtgattccttcctgagtgatttttttaaaaaagcaaacttacttgttacctttacatatttaggtggaaattccttgagcttttcagcagcaactcgtattgttaacaataaacagtaatgttggaaacctcaaaaagttttttattttttccatagatttatagttttgaaaatacaaacgattctatatcgtgcatttgtcaagtagaattttgatctcaagcctatacgaggagaatttttggctattgaaagctgtgtcaattcagtggagtcatcaattaccccacgtgataaagcgtgtttggtttgattcttttggcatcatatgggttgtttctagtgtagtgctcaaacgtgtttttatatgttgatattttgatatcaatttttactaaatttcatacttgtgaatcttgacttacaattagtactaatcgtgtaataagcagtatttattcatttcttttcctgtgataatcatttgctctgttaatgttttgttgctgtggtcctacactaacctgtcatttaagtgctagtctttaacctaacttactcaaagtgtctcttttctcttaccctaatccttccctaataccccatctcaagtctttaaccactatttaaatagaatgttcctagagtgggtcccaggatttgttgattgttgctttacattgcctaattgaacttttgctatggaaaattgcattttcattctcaggaacctcaaactgttcacagtggtatgggattttgatattttatgttaacgaacagatgtgtgaaaagaattctttataggggacactcgagtttatattttattctttttccttcagtttctcttcctgtaatgtcaaattgttaatggagatcattaaagagaattgttact

SEQ ID NO: 177 - DNA, 5108 bp, Leptinotarsa decemlineata
  Annotation=Ras GTPase-activating protein 1; Tribolium gene name from OrthoDB database=TC016087; Blast E-value Tribolium Gene vs. Leptinotarsa Unigene=0
gagtaagtactggataataaagaaaaggtgaagaatttttaattgaaaaatgccgtaggttaattactcatcaatataagataaagaaaaggaaatagaataaattctagctgttggttgatatgagccttaagttacattttgaatcgatatggcagaattaattcgtgtaggaagtggacacaatgctgggttaatgaaagacaaattgggatctcccagtacaggaagcgatgacggaaacgaacaagaaactcaggctgcaattaaaccagagccagaggaacttgatctcggtgacagtgcccattatgcacctcctgaaactctctggtatcatggaaggcttgatcgttatcaagccgaagaaagattgtggcagtgtaataaattgggggcttacttagtgcgagagagcgataggaaaccgggtagttatgttttgtcatatttgggtagaagtggaatgaaccatttcaggataactgcagtgtgtggggatttttatattggtggtcggcagtttgtttcgttgaatgacttagttggctattataaggaatgtagtgatctgctcaagagagaaagattagtattgcctgtagctccaccagaacccgtgaatgataaaaagagagtggttgccattttgccatacacaaagatgcccgatacagatgaactaacttttaaaaaaggagatatattttttgtacacaatgacatgggtaatggttggttgtgggttacagcacatcgaaccggtgaacaaggaatgatttttcgtgaactagtagaagatttggatgatagtatagatcctaatactgtctttccttggtttcatccagattgtacaaaaaatgaggctgttgatctgcttgtcaaagctggccctggaagttttctagtacgtcccagcgacaactctcctggagactattccctttttttccacatcaataatcaaattcaacgttttcgaattgagaaaaaaggagtacgatatcttatgggtggaaggatatttgaatgtcttgatgccgttatcaacagatacaggaaagaacaaattgtcgaaggatatactttgcagcatccgctagttgttgatggttccaagcagctcgattgggtgccagaaaatcaaaaggcaaaatcagaagctgaaaaaatttatgccaccttgagagagtgcagagatcaagcaggattgaaaaaaatgaggggaattaaacatcaaggatacctgcaccgtaaatctgataaggctgctaaaaaatggaaactactctactttgtactacttgtcgatggaactgatactcacttgtacctatatgaaaatccaaagagaacaaaacccaaaggactcatagacctttcttgtgcatatttataccaggtacatgacagtttatgggaacgttcacattgtcttcaattagtggagcgggctcttccatgtttggcgactgtaacccatctcgcagctcgttcaacagaggactgccaagattgggtgaactctttgaaaccattatgcgttcctcagctcagtaaggctacttccaaagtgccaagattgagagagctcagatgtcttacgttgcatattcttgatgcacaccgtttgccttacaagttagtgccacagccgtatgttaccatacaactcaataatcaggttagggtagcgagaacaagaacaaaatctggccccgatcctgtttgggaggaagaatttgtctttgatgatgtgccatgtgatattttatcgtttactctaactgtacataacagagggaaaagaggaaaagaacaagaagtagctgaactgcatgtggagctagcttctttgggcaatggtgaggaacgtgaagaatggtacactttgtctgggctaactccaatgggagaatggggttctttgagactccgtaccaggtatttacacgatttggttatgcctgctgaagaatatagcccacttcaacaattgttactggaacctggtctcacttctgttaaaactttagctgaaatatgtcatgctgataggggacctctagccactgcactgttgagagttttcagagcagagggaagagaaacggaacttctaagagagctaaactctgctgagatcaacagggagactgaaacatcaacattgtttagagctgcttcgttgtcgaccacactgatggatctttatatgaaagcagagtgtggaggatttttacaagcagctgttttggaaactgttctcagactcctggaaagcaaacaaagtgctgaactgaacccctccaaaatggataatttagatgatgcctgcaataacgcagaattcctgttacaaattttagatcaggttacgctgagtatattcatgtctcctgatgcctgcccccgttctgttagatacatatgtggctgtttgcaaaaagctgttattgccaagtggcctgatgaaagatttgtgcgaacaagggtggtgtcaggttttatttttttgagattgttgtgcccggcattactgaatccaagacagtttggtcttgttagtgaacaaccatcaccttctgctactagaagcctagttatggtggctaagtgcttacagaatcttgcaaatctggtggaatttggtggaaaggaaccatatatggaagtagttaatccgttcattctgaaaaataaagagaggatggttgtgtttcttgatcaattatctatggccggagatccaggtgaatcaagaatcacttctaaactagacactgccaaagaacttgctacactacatcacatctgtgttgctcatcttacagagctccaagcagtggctaaaatcaattcaaacataaaaactttagtcactgtagctgatatgttggccaagcacaaacagaaatatttggaaatgattagataatagtttagaagagaaatgtatcccagctttcaggaatagaagcaaagtcagtagttttattttattatgcagggttttttatataatggatttaggctgattttgatttttatatttttttgaaccacatctgttcattaggccttgtgttcaatctgattgatctccaaatgttcctttatactgttttgaatcagactttcaaaattatgatcatattcaatgcttattttatgaagagtagcttgcacatcattttcaatatttcatttaacatttcaaaattgtttagttgcagtatcgctgttaacttcaatttaatgtgtattctactctgccaactttcagatggccaagttgcgaatttaaaatgtatagtaggattttttcattttttaatatatatctatctttaaagtgatctctaatttaacgaatcattcgttttggaatgttactgtctagtggagaaaagaattatttaattagttagttttttgggtaatgtactgacctttatactgaaatggagaaagtgaacaaaaaaaaccttttgaaattacctttttgtcattaatatattatacttttggttgagattccaatttatttattggatcacaattaattcacaattatacgaaaagaactctcattgtgacttacaattatcctatacgaaatttgatttttttccttaaaatacattattatttcagagattatttaaaatgagtagacttttttcaatatgtgtaacagttatctgacttactgggcttcccaaataattcttgtcttcaaattcaccattgtaataatcagatttcaacatgttctttattaattggaaatgtactaaccactcaatttcaactttattttattgttgtttttttatttgagactagtttatgaacattttgtaaagtacgtgctcagtgtgataaatcagcttgttcaccatttccaaattattcttattttattaaacttatctcggtttatttggtgcggcaatataaacaagtgtttacaggagtgtttcaacagcaaacctagtcgccttagaaattcttgtgaacatttgctattttgggaagtatcagttgagaattgtgataagattgaattttctgttggaaatatagaaatagctttctataatatttattggaaagatcgaccaatgaaaacattcatttcatacgttctgcattgtgtaaacatgaattattagtgccattacctcactcattcactcaataatatagctgtacaaatattatactcaaattctatattagtccaatcatccgaagttgaaaaaaatatctaaaattttgtcacttttcagtttgtttttacatcataattcaaaaactaaacgttttttgaaagaactcattgcatacaaaatttaggcagatataatttcttattaaatgcatgtatcaactttaaaatttagatattatttgactccgccagagcgcactgatagaagcctcatttggctcttgggggaaaaagaaaaagaagccactctgcagtggtgtacttatataaatgatatcatattttatttgaattcctattatacctaggtcactattggataattggtgagaactaatgaggctcatgatcgacaaaggcgctagtttaaaagaaattggttcaactattcttcccgatgtaactaaaagtatctgattattttgaatgaagtgaattatatttccaataataaaaccaatggaattgagaaaggtggctgtcaatagtttgtataactttgtttattgtgtcaccctagttttgtaatcctttttgtaaaatggacttaattcaatttatattcatataaacacttctgaatggtctctgcattgttcttaaggttgaaactatatgtgtgttattgcaaaatttgatttgtttccattttttaaagatttcaaatgttcttaaattccagattcaacttgtatgtcgatgaagaattcatatttcagtttgtaaattaaacttctgtcaaacttctaaccacctacaatccgacattcctttgttgtgctcctttttctccccttagggtatcttctcaaggccacctacttgtgttggctggcttgatttcagttattgggcgcggaaaacgtta

SEQ ID NO: 178 - DNA, 1112 bp, Leptinotarsa decemlineata
  Annotation=39S ribosomal protein L2; Tribolium gene name from OrthoDB database=TC000434; Blast E-value Tribolium Gene vs. Leptinotarsa Unigene=4E-153
ccttaaaaaaataacttttatttccaatttaattagtaatgaaaatgattcctcggagttttcacaaacggcctgtcacaactaaatacaatagtgtctatgtcatcctgaaccagtgggacgatagttttaactgggggtggtcgccttattttccttccatgacaacccttctttctctgccacaaacctgatcttggtcggtttcccaattccctatttctctgcgcagatcctatcggagtatttccgtgttctatattactcaatcttcccacagtacacatgcagatggcaggcagactgaattcctttttcgatggcatcatgataacaacatgatcattcggggcctttctcactatggttgcatatgttccagcagaatgtacaaggaaacctcctaaaccagggtatttctcaacacagtgcacttgtgttcctattggtagggctcctagtggataggcatctccttcattggctctgactggtatcctaggtatatgacaagaagttttgatcaaatctccaggtttcatattcacggttgccaggatgtactttaacttatctccgttcgccactaaagctatatttgctgttctacaaccatctttgatgatttttatcactttttctacttgaacttgaccctcttcacttggaccaacacgtttccaatctatccaatgatatttatgttttatacctcctccaatgcccttcacaaccattctgccagttttagggtctctgcctcccaaattagtaacgtttaaaggtttgactgtgtattcttcaggatagtgaactattcttcgaaatgattttccatggccgatttcaggtttttccacatgttttgctttgtatcttacagggattaaagctttagaacatgtagcagaagcgtctagtaatgttaatctattaaaaatcctgactaaagtacccatctcagaaactatattttacgtttctttatgttgaatgatttcaattggttatgttgtgctgtcattgttgtcaatccatagacattacaactattgaaccggtcatcccgtcacttaacttcttgataccgtgcagactacattaaaaagagc

SEQ ID NO: 179 - DNA, 4567 bp, Leptinotarsa decemlineata
  Annotation=Protein FAM21C; Tribolium gene name from OrthoDB database=TC015827; Blast E-value Tribolium Gene vs. Leptinotarsa Unigene=3E-68
aaaattttgaattattgttttcttgctcctactataaacatgagaaagaaagagagagagagagagaaataagtttattgtctcaagaaaaagttcttgttgacaaacaacagtagtataaaagtagtagctaaaatcttgtctatataaaatagaatgtcaaacacatttatacatagcaaataaatgtatgtttcttgggaaaataaatcgttactattgaaaaaaaagacctagcattcgtaggaaacaactaacatgtccacgtaggctcctgatgttgactccactcatagtgctttgttgtcccctgtttccggaaaccaggtgttgcccatccatgcactctgctgcatcacgctgatgaggccaatggccagaaacacatgtccgcggtttgcaagtgtccactatattaatgagttttcatgtatgaacaactctatagaaataatacacctctcgaataaggaagaaaattcgtatcaacgcgacgacctttcagaataagttagataaaggatcttcagaagtctgaatattttcaagtttttttacagatgctggtttatgaattgtcttattggaggacttgaacacagactctttcgttttcgtaatactagagctgctagcagtcgaaaacaaatcttcatcgctcgattcatcatcgaacaatttttttatctttttagacttagcttgggaagagctgaacaaatcattgtccgactcgcttccggaatcaaatagacccttggttttgttggcggtaaattctttagaagaatcttgtttattgacttgatccttctcagttgagacattcaagtctttggacgtttctgagaaaatactttcagtcttcttttcctgagagggtatttcatcctcttctgcttttcgtggtgttacatccattctatttggtacatcttcaacttctttcttttcttgtttattactcaacatagagtcatcatctattacagactttctcattgcagcttgacgtcctcttcttgttgatgggcgcctgttcagaggaagctttgctcggtcctttgtaacactgtgtagaacctcaacattgtcgacgtcatcaaaacttactgctttttctaaagtggttcctggcagatttttacgaacaacaggaatgctggatgtttctactgtttcagccttcaaaaaagtatgatcctccctttttgcagaatcaagactttgcgacttactcaattctctggctttttgtggagaataaccaggcatcagtgcatttacattaatattcattgagtgtctcaattttccaggtgaaacttttatattgaggttattactttccccttcatttttgagcatgtccattatactggatatcgcagaatttcgtcgagaacccttgatttcactttccattggactttgtaacacattattttcatgatcgttactgttttggttgataaatatattcttaacatcatgatccctacttacattacgtgatatttcattactttcttcatcctttgcaaattccaattcatttttgatagatggctcatcaatagcaaggaaattgttctccgaatccaaaattttgttgtctgtaggttccatccctggaatattttcgctaggtgttatgttaaccgtgcttatatttgaaccttctcgtataatatcaagatttgatggcaccgttgctgagtctgctccgcttttagtaacaaaaaggctgtcttggtactgctgttcactgaatatatcagaagacaatcttcttgaagaagaggcatatggataaaaagatgaatcatctgtgtaaaccctggtgctgtgatctctgactatcccactggaatcgtttggacccaaggatggtggttcatcatcaaataagtttgatctttgcaaattttcatcagcacgatatgaggtataatcatcagaatcagaaaagttatcggattttgtatcccaatcaccatcgtcgtcatctggtggaggagttgaatcgaagagtctaacaataactttatcttctttctgttcagaatcgtaccttggaatagtctcttgcttcggtgacagatgagagactacgttttcttccaatccagatgactgttgctcctgctcagtatcaaacaggcctttaccaactccttcaaaaagtttcgaaagtttatcattagtttgtgcttcatcaacatcaggaaccataaattccctttttatagaattttcttcaatattaacgtgcaatccattattatttacgctgtcatctttgacaggcacctcaacgttattctcaaactttggatcatcttcaacatccatggaggaactgtgacttcttttctcttcacctaatacactaacggtatcatctgtaatgacttcatttttgttttttaaatcatcccttcttatagtgttgtcaacactgcttgtcttctcactaaataaatcatttgaatcaaacaagttagatttgaacttctttgaggttaattctgagaataggtcatccttgaatagttcatcatcatcatcatcgaagagactgatatttgttttttgttggctagaatgctattgaatttgtcatcgaatagactgacatttttgagtggtttcttttctgtctcaacattgtcatatctctttatatcttgtgatatatcttcagacttgactgattttgtatctggatattcttttttaatgagtactttgttttccatgtcactatcttcatcgtcaaaaaggttatttttcttgagaggtacttttttagattcttgagaaaagttatcttcagtatcatcgtcaaatagactgaattgttttcgtctcacttgtctcttatcttctggaacttgctgaggtataacagacgctggttccgatgtatttttctcttcctctttgaagaggtcatgggtgatattctgttgttgatttttgagcacattttttatttcgtcgttgccaaaaatatttgaattgccaaatatcgacacaccgccagtgggtttctttttgctgacttcctctgttggtttatactcatcttttaatttcggtggttcatcttttaatttcggtggttcattatcaaacaatggaacacttggtttgagaaatggcggtttagcaaatggagttttacttgttgaaaatatatcatcatcactactatcatcactgtcaaatagacctttgctcacttttgaagatttaggcaagaaacttgtgtttttgtcaattttctgtcctgaattttcactcttatggtcatcatttcttgttgtattgaatggcattttgttctgattgccgccgtgaatggagtcaacatcatcaaataaacgttctcctcctgaaaatataccagcgctagctgattttggaaaaagtctatcctcaggttcactcaaaggaggtggttcatcagagaagagattaccacaaaatgtattacttctcacgggttggattggttctttattgatttgtccagttagattttcttgtgtactaataacactgtcaagtttagcagccaactgttcagcaaataatttacttgaaatcgatgcatttactgttgaattttcctgttcttcacatgtggtcactaattccggtcttctggtagaatcatcaaatgtcgaatgagctaccggtcgattttcacttgtttgacttgaaaagtccaactctgagctagtttcggatcctttgaacaaatcttttggcaagttatcttccgaatccgattcactataattatcagccattttatcatcatcactgttgcttgaagagtcttctgaattccatcgcttataccattcatcagttccaattacaggaggtaatggacggtgagcataggtatctttcggttttaaaataaaacttctttcaggttcttcatcttcttcagtatcactaatagagacttctaccatttcataatattggttcattatctccaaacctaaaataactgattctgatatcattttttcttgatcttcttcagagggtggcttttcaacaactttcccctcttccttactatctaatgtttcgtcatcttcataaactcgattttcgataaattgtgtgtttttcaagctgtggaactgattttgagaaatatccagtttcaagctgacttcatctgcatgaaccaataagttatctatattctgactcaattcttcagtttttcttagcatgttttttgaaaatgatttgattgtatttaaaagggctacatcgccagccaatgaccacttgttagcattttctagaatttcatctgttgtccatgctttatcagaattccatttgctttctgattccatacttaatatcctattgatctgaaaagtgatatattctttaacaaattatttaaatatgcgattccttcatttcataattttcattgccctttttttcaatttttcagatgtcttcttcctttagccagtgtcaccaactgccaagtcaacccaataggccttttcattac

SEQ ID NO: 180 - DNA, 2784 bp, Leptinotarsa decemlineata
  Annotation=Ischemia/reperfusion inducible protein; Tribolium gene name from OrthoDB database=TC030645; Blast E-value Tribolium Gene vs. Leptinotarsa Unigene=8E-73
gactcacaatgtgctcttcattcatgtgaaaatatgttggaattttgttgcttttgttcgaatttattattcgccgaagaaaatttgcaagggaacgttcagttcacttgcaagttatgtcctatttactttcgtgtgaaaaagcttaaactgcacaagaattactctgaactcaagaaaattgatgatatcttaggaggtgaagaagcttggaaaaacgtcgattcaacggaagaacgttgtccaaagtgcagtcacgatcgagcatatttcctgcagatgcaaacaagatcagctgatgaacctatgaccacattttatcgttgctgtaacccagagtgtaatcattattggcgagactgattcgatcaaatgcttttgaagttgaaaacattgcttggttctacaggtagattttcaaagatggcatacttcgaatcttctccgacaactgctcatatttccataacagattccacagttgaactgacagccgtgaattatcttaagtctggatctgtcatagccgtaccaacagatacagtttatggattggcctgtgatgcaactaataaatctgcgataaatcaactatataagatcaaatgcagaaacgaaaacaagcctttagcaatttgcctgaacgaagtgagtagaatcggattatgggccagcgttcaccatcttccgtcgaatctgctgggggccctattaccaggaccggttaccgttattcttcaattaacaaataacacgctagacaagtcgttgagtttgaatggaaaagttggtataagagtacctgattatgattttataaggaatatttcgtgtggtttgggcaaacccttggcactaactagtgctaatttcagtaatcaccctagtgctgtggaaattttacaatttaaatcgatttgggataaaatacctgccatattcgacggtggtaagttgaattataataacgaaccgtcaactatcattgatttgtcagagtccggagtatttaaaatagtaagagagggagctgctttggaagaaaccatcagtatgctgagaaaatttggattaaaacaaatgttgtgatattagtgtttttaaactgagatgagaggtacaatcaatttctatcatttgtatctccagtattagcttctttatctcgtgacaaaagactttagtgagtaattagtattttaaaatactataacagcaccagtagtgagaatatgaaatgtattttcaatgaattgatggatgtagccgttactggcaagtaggagatcatcatgaaaaacgagaaataaagctttctatatttttttaccacttgtatttgtaactatcattactgcagtttcgtcctataaggacattttcaaatgaatacaataagaatttattgtatttacaaatgcaagtggtagaaaacatgaagttttatttcatcagttcggacttccattgttcaatgaaaatgatttgaaatccctgaaagaatgaataaaattaaaaagatcagcttaaaaaactaaacttttcattgcaataactatacctaataataaataacaggcaggctgaaaagttcgtaggcttacattgaaaaaaaaatgtttaatcataaaatcaattgttcaatgtcgttgccttcgaggtagctagcggtatacaattttttgatactagcctcaaaataggcgattttctcttcattggcgcgaaattttcaaaaagtcactgggggccaaatctggagaatacggtggatgagaaaacaattcaaagctatctcgatcaacttcactttgctgtcattcaaaatcattttgtgaacttttttgatgttttcgtcggtaacggcctctttgaggtgtccacggcatgcatcgtcctcggtgctcatttcatcttgttaaaacgtaacaaaccactactcagtggttgattttcccggtgcaaagtctgaataatgtttatcaagccaagccttggcttcaatagtatttttttcgcaaaaaagcaatgcttcattacttgaaattaacaaaagttgcttcactcaaaatgtaactaatagtccgacagctgtgaaatatgtacatgtgtcttttgaaagtgaggtttaactgaaagattcaatactagtggcgccatctgtgtgttagcctccgaactttttattataataagtattatttatatgaattttttatttattataatcagtaaaaatgtcattcataaacaaccaataaaaaggtggaaaaaaagatgaatacgaaaaagaaaaattaaaaaaaagaattcaagccaagttactttatgatgttgagtttattattcgcaatctgtacttttttgtatttctttattattttattttcatttcgttactatatttaaattttttcatttcacctttttattgtttgtaaatgattaacatttcacttattggttatttcatttccataatcaatttcgtttcaggtcaccataattcattttctttacaaataaatgctattataatttttgctactaatgttagttgttgattttttttgtttaatttctgttccatagatttcaaatgtgttaaccagggaagtattagcttgtaatatactcgtagtgattttctgtactattgaagctacataaaaattgtaaccaactcttcacgcacttgaaatattcatctctcccaactacctacacagtaggttctggtaaatgcctgccggaaggcaactgctttccgggctaataccaccc

SEQ ID NO: 181 - DNA, 2086 bp, Leptinotarsa decemlineata
  Annotation=Integrator complex subunit 10; Tribolium gene name from OrthoDB database=TC000758; Blast E-value Tribolium Gene vs. Leptinotarsa Unigene=0
atgtaaacgaaaccacagaatgtaaacaaacaaattgaaatatatcgaagcaatggaaatcgacttggaaatatcagacgaagagtatgtcattcaacgagcaaaggccgccttctcgtccaaccccgtggctgcgaaggcatggatgctcacagcgaaaaccctctaccccaacaactttggggtacagttcgaagcataccacatcgaaaaggacgcagggcacgtcaaagaggcggccaagtgcttcagtgagctcatcaccaaatttcaacagcaccccgatctctggaaggaggtggaaaaggtgaccgtggccctgagggcagaatcagacaccaacgatgccgaaacgcaatttctatgcgagatgtttcggcatatatcctctgacgtgcaacacaagctgttgctgttcacagctgagcactgcgaagacaccatggagcactgtcggctgctgcttctgctactccagcggttccccacagccatctcaagcaacgggccccggctggtggaaacgctcatcagcgcagaaaaacacagtgtggacggtcactttccggtcaacccgtacagaaaattgttggtgtgcgacttgctcccgcttctgggcaatgaaaaagccaaattggaactgtcgtcaaaactgctatacaagcttctacacaaggccatcgagttctatctgtgctacctggggttgagcaccagcgttatccaggacaccgagaccaaaatcgaagacccgtgggggaaactcttcaccgtattcgaattcatcggcaaccagctcaactgggagccgtacctcatcaacttcaccagcaactggtccaaagaggcctactggcagaagatcatcagcttctgccagagcaagacaaagtcttatccgctggaagacaagcagttgttgttctgcttgtcgatttacttcgtctattgcttgtttgagtacaacgccagcctgacgcctgagtcgagccccggccagatccctacgacgtatctgttggtggaagctttctcggacccgaatctgcccagtctggtggctgaaccaaaaactaagaagcggaagagtgatgttgatgggagtcaggttccctgtttgacggtcgaaaaacccgaactcaagcacatacagagcaacttcatggtctgcgtcaactgctgggacctgctgaactcttccgatagcttgcagcgcgagttcataaaactgaacgggcacctcaagctggaccccctcctggcgggtttcgtgatcgactacgccctatacaagggcctctacgatgaggcgctcatgttcctgcacaagataaccgatagctcgcttctgctacaaaggcacatgagactcacgagtgtcctctacaccaagaagaactacgcttcgtgcttagagccaatcctgctggcgctgcctctgctgccgagtaataatgtgggttgtctcagcagcagtttgatcatgggcggaagccagaaacacctgcactatctgccgctgaccaagacggccgctctgcagtatctagtcaaggtgttactcagatgcgtcaaagaaaacatggcgaagcacagctacagcgagctgtccattggccatattttcaccctggtccagctcgactggccccaagaggaagacttcgtgcccccacttctggagcagatccagcaacaccgcacgttccagtatcacaacttccaaaactacatcttgaatgttgacattctggaagaacttacctacttgtggacgagccaaggcgggcagattaacctggacatcttgcctcatctcggacagagaaggataggcaccagaggagcagacaagggagtcaaggaggagatcaggcaggcgatacgcaggcagatctccaggagtaacgagaacctggaggagctgttgattagcttcatcatgaatgagcgtgcgcagattttacagacactagtgtgatggtttaacgttggttgattcaaatattgttgttaaccttggaaagtgcttcaaggactattcgagagcctttgtatattatttataattaaatcagttgatgta

SEQ ID NO: 182 - DNA, 1948 bp, Leptinotarsa decemlineata
  Annotation=Transmembrane emp24 domain-containing protein 6; Tribolium gene name from OrthoDB database=TC012624; Blast E- value Tribolium Gene vs. Leptinotarsa Unigene=4E-121
gaacgagagaataaattacataaataatgactaataatgagaagttatagttgattttattgaaatccccatttctaacttgtgataatatatttttaaaaaaatcagagtttactttgagtatgggaaagttttgttcattaatttataccgtaagtgtattgcatacagaaacgctttacaatcaagacccccttttcttgaagaagtgaaagtctgcatattcagtagaacgacttttcttcaagtttaaaaaaatgaccggggtgaaacgtgtcacattattgctgaccagtaaaatattgctaatattgtgctttttgaaaacctcatcactgcaacaagctcctataacagtaccatggtatgaaaatctgccagctgttgcaatggactataaagtacatatagatcctggtaaagaagactgctattttcaatatgttaacccaggggcaaccttctatgtgagctttcaagttgttaggggtggtgatggaatggcagggtttgcagtaagacatccttctggtcaaatagtccatccttaccagtggaagcccaatagtgaatatcaggatcaaaactctatgggcgggtactattcggcttgtatagataaccagttttctagatatgcagcaaaattggtgaatatttacattaccgtcgttcgatatgatatgtgggacacatttaccaaggaaattgaagaggtaaacatgaatatggagaatttcaccacttcgattgtgggagttgaaaggaatatcaacgaaatgcttcagtaccagcaccattcgagaggaagagaagcttgggactataatttgttgcaagataataactcatatgttgtacgttggtcacttattcagattattattataattgccacaacagctgttcaggtttattttgttcgtaaattgtttgatattaaaagcgggagaggatcaggaaagtcacgaatataaatttcgtataattgtagttaagacaattaatttaaccatttccataatttcaaaaacaacaatattattcatacttcaagttcaaacttttgagtaattttgcaatgtaattaatgtttaattagtatctacaaagaagtacaatcaatgtccttcatctatatttattatttaaacacgaaacatatttagatacattttttgttttctgtgaaaattgtagctataatttgtagaaaaatcatgaaaaatgagaactaaaattactatggatcttcatcaagtaacggccgaatcgatcagaaaataaaacttgctatgttttgtaccagttgtatttgtgactaatgttgctgcagtttctttctgcagggatattttcgaacgaatacaactattgtattcgtttgaaaatgtccttgtaggatgaggctgcagtggcattagttgcaaatacaagtggtattaaaacataggaagtttaaattttcatttttcatgttgatctccatttactaaaaatgatgaaagctgtctgttgactctcttactcttgatgtgcaaattacacgagaggctattgtggaaaaacttttgtgagatgttggatttatatctatatttttgtatactttcatatgaaaatgaatttgagatatttttttaaagttttatatttgatgtgatgttatattctgattgttatattttctgaaatattaactttgttacataagtatggatgtaaccagactggtcttgaacgatgaaaagatttacttgtaggaatatttcttcttctcaagttgatggaaatccttttatacatgttatcatgaggtagagatagttatgagtcgccaatgaaaatgttttgtggcacgatctgtcttattaattaaaaagtttcgaatattgtgaaatagcaattttataaaattttactttatttttataattctatttcaatt

SEQ ID NO: 183 - DNA, 3614 bp, Leptinotarsa decemlineata
  Annotation=Peroxisome proliferator-activated receptor gamma coactivator-related protein 1; Tribolium gene name from OrthoDB database=TC011963; Blast E-value Tribolium Gene vs. Leptinotarsa Unigene=1E-88
gactaatagtgaatataataataataataataatattaatgaatgaaaaatttcaaaataattgtcatgaattaattatactatgataaataagtaaatacatgattccaatactgttaaaacaaaaacagtgaaatcaaatttgaatccctaaaaatataaaattaaaatacaaatttggcctaaaatttgggtaaagcataataaccgtcaagctttacgttttcgcaacttctcctgaacatctttcaacaatgcgtcgaaagaatcttcactagctcttggagcaaaatatccactttcatcacgcatattatctagatctgaatatgtggtttgacagaatattctacgacctccaaagctcaagtcgtatttaggttgccatggatcatcattaccgtgctctatagcctcatatgcatctaatttattggcaaatgtaacaaaaccatagttgtctagatacccatggtcacgtgcatggagacttatattcgttatagggccaaacctgtggaatctccttctcaagtcatctcttgtcgtaccatgagtaatacgccccacatatattacacgacgctcttcaacttctagtaaacgttctctctctttacgagagtatcttggtgacggggatcgcgatcttgttcttgaacggttggaagatctggatgaaaatgaggatgatgacctgtgagaggcactactatgagagcttcgtgaacttctagaactctgtgaactgcttcgtgaactctcagtacttctctttctgctgggtcgattggaagtctgactttcttggctctcactagaagaatctgaagaagaggatgaagaggaagaagtcctcctccttcggtacctactagctttcgtctgttggataagagaaatatttgtttggcattcaatagatctcgtttgtacagtagccctatccttaggtaaatatacaattgttttatcttcaccatgttcaaatttgtcaacgggaacctctgctttcagttcttgttgatcacaactgtctataacctttggaatattttcaatgacagaagttatgagagagtttgaattaattttatcactgactttttgcaacaatggttttatttcatcaagttgttctacaggagctaaaggatccaattttttacgacgtgtcttgataccagtattcacacccacactaacaagtgtcttcttcaccatgtcaactgggacttttactggttgaggtggagttatctttagaggtaattctgcctttttctcaggtctaggtggagtgttcaacacctccattgccattttcatgagtttctgttgatgacgaattctttttgtgttttcatcttctggtaaaggagagctacaactactggtgttaggcgaacagttctgggaattattttggtatttcaggaagccctctcttcgtttcttgtattcctccaagttgagcttcttcttctgtgtggatttgttattgtgtatggtattaaccttcaacagtgataccatcaacttgccatcagcatttttgacagttggttgtttaccaataataggtcgatcatcttcttctgcagattcaaatccagaatccttctttggatgtttggggtaaggggtagctaaactacaatagtcatgatcaagttggacagtgtccgccctactggtgtttctattctctttgttagacgccatcatagcgtcatgcatgcgaggtcccccacgttttttggcaggcatcgggggaattacagatatagttttacgttttccagattcctttatacgagctattaattcttggggtaatgaatccataatttgtttatttccagctggatccaattgtgacggagaggtagttgattcgggatttttgtgaattttttgagcactgttttgttgtgctgatgacagcgatcttgataaggtggtcttatttggaattgcacagctgaagtcatatttagttttttttccactatttgagatttgtagcaatgtgttttttccagaagattgcttgttatctttatgatttttattaagttgtttcacttgttcagctttaatgtactttgtttctgaaagaggattattcccctcaacattaacttgaggaattttatgatgatcagaggttcctctttctgttttaacaatttctttgtttggtttcaatttattctttatgttttcttgtccacataaaggctcatctttcaccttaacaatgctggaatagttacactcctctttcaaaccctcaatttcaagtttttgaagagtagcttcaaaatttatttcttgtttcgctacaaaactacccttctgttcatttgtttgaatttctgtttcttttaattctgtcccgatcatatcaacttgttgaatttttcccacctgttccactgaaaaaatgtctggcatcgttattgaaccagaatcagttatattattttccatcagtatttcttcaggttttattgaaatattgggcagttcatatggttcaaaatcattttcaataatgttgataggtaaatgaggaacagttgcctcaaattgttcaagtaaactattgagatcacaagcctcaagaacggttggattttcctctttgtgaaccgccaaattctcctcattttcagatatagtctcaacatccacctcatcttcatcatcatcaacaatgtaacgctgagctttcagatcaatttttttgacaggtgcctttagttttttctctgaactactgaatgtagggtttgcaggaggtacactttcatcctgaactatataggaggttaaatcaaatgattcgtcaacaggtaaattaaaataatcatttaagggtgagttactttgttgtaccatttcattttctgtttcttctggagtaattataggttcctccatccggaattcatcgctaacaagatccgtactaataaatgtctgccaatcattcatgattttttgaaaatcgttgggagatgaatcatttaacctcgaaacagtcattggaattagtgctatatctccatttatctccctttcaacatccatattccattcatacatgtcattttgtccaaagttgggaagattgtccagactggtcgaatcgtctagatagttttccacataattgcaagtatcaaatgtggagaattgctccccatctctgaaagaatctatcatatccatactgagtagacaaaaaagctttaatccaaatttctgcagattatttcagagacaacatttacagactctcctgaatctcctaaacaaatgactgtaccggttttctttgaaaaatcacaaattttacgtaatattgtccttctgatagaactaatattagttataggttatgaagggaaagcacacatattccaccaaatttaactcaagtacaccaagtctgaaaagtaaattcaattgaatataactgccgataacttccgaacttgtttttgtttacttttgcctctcagccacttttatttccaactattttgttattattccaaaattgtcacatgtggaatatgaatcaactacctctacccctcctc

SEQ ID NO: 184 - DNA, 1061 bp, Leptinotarsa decemlineata
  Annotation=SCF apoptosis response protein; Tribolium gene name from OrthoDB database=TC030547; Blast E-value Tribolium Gene vs. Leptinotarsa Unigene=2E-8; Blast E-value Tribolium Gene vs. Leptinotarsa Unigene=0
atgtctatgtatgttgtgcttgtgcatgtcacaaatttgtggtgatatgtggtatgttattttgatgagtaatcagggctagtttttcaggtattagttttcattattgtgttggcccacaaataatgaccagagaagagtttgaggaaggcccaagtggaaaataaagccataataaccaatttccacctaacaattctgttgctgcccaaagttttcaacaggttctttcttcatcatagtttcgaaaatgactccaaagtatgcactccgaattgattgttaaaccatgaagaaattgagtggctcatttcgatacagccagtgggatccatggctaataatattccagatagtctctattcagtgtatattgtacgtttctttaggtttgatattagctgttttgggttccttggttggagaacccaataccttagatcatatatttgaataccatgaacttcaaattcgtgattttggtgggagaatagttatttcaagttttgtcttgaattcattaattggagctgtggcgatatggtacatcgtagaaaggacgaaacaatgcatggacttcagctgtacctggcacttcatccaccttatcgtctgctggttctacaatgaacatttccctacgacattctcttggtgggctctaaacgttgcttgcgcaacattgatgtgtgtgtgcggggagtttttgtgtctcaggacagaactggccgctataccattatcgctaggccccaaaaccgacctttagatcaacaagttgtgatattcagtgaagtcgtatgacttggaaaagttgtctgtgtcgagtaactgaaatcaattttttatgctagttttaaacattgttttgtcgagaagtaaatgaatttattgccacgagttcattattttttatatttcgagtctgagaataggatattttttcatagtctggaagcaatgtctcaaaatataaatatggtagatactcagtgtgatatattttagaaccgttttgaaacatccaaaaatcaaagtaaatgctgcaaaacaaaatattc

SEQ ID NO: 185 - DNA, 3360 bp, Leptinotarsa decemlineata
  Annotation=Glycogen phosphorylase; Tribolium gene name from OrthoDB database=TC008246; Blast E-value Tribolium Gene vs. Leptinotarsa Unigene=0
taattaacatattcatttattctttttgttctaaacagtcaagagtaattatctttgtttcaagaaataacttttgaagcaataatcgataaaatacataaaatgtataataatatataacaagagttatagtaatctcatacttgattcaacaagtggacatagaaatactctcttcattgtaacaattgatataatattgaaataatcctgccgactttgcgaaaaaattgctggatttttataaaaatcacttagtaccttgattcacagttattagttacaaattttgactttaccacttttaaattgaaaaataaataaaaagactaaacattgggtagaagttatgttgagtgccatcgtcacatcatcgtgagtagtagcactgtatatacaaagaaaaataacttttctgcttcccattattggcactttttgtacttagatggcacaccgtagttcccaatacctaattgctggaaaattttcataatgatttttgagtattgcatctgcaactgtttatcttgagtgaatgttttatcgcatggagctagcgacagttctgttgaaatcatgcaagaactttcaaaaaatttaagagatgaatccaaagataatagaagttaaactccttacacgaatacgctactaatgtaaaacaactttacaaaagtcgtttgaactaaatcgataagagcctactttagttgtctttcaatgccagttctcttggaacggacgggtcaggaagtttttcgtaattgggctctactccccatatgtctttgccgtattctattatggtgcgatcacttgagaattttccagaggtggcaatgttgttgattaccatttccaaccatttcgcttgattctcgtagacagcgctaacttcatcctgcttcttgatataagcctcgtaatcagccaacaggaaaaacctgtcatacttcaacaaaatatccgccaaatccttaaactcgtctggatttcctggactgaagaaaccgttctcgatctgatcgatcacctgcttcaactccgggtttgagttataataatcataggcattgtaacccttcttcttcagctcttccacctcttccacggtcatgccgaagatgaaaatattttcgttacccatttcctcggccatttcaacattggcgccgtcaagagtaccgatggtgagtgccccgttaagctggaacttcatattgcccgtaccggaggcttctgttccagctgtagagatttgttcgctcaaatcagccgctggcattattttctcagccagggtcacccgatagttctccagatagataactttaagtttgtcaccaacgatggggtcgttgttcacaacgttcgcgaccatgttcactagtttgatgattttcttggctgtgtaatacccaggtgcagctttgcccccaatcatgattgtccggggcgtaaatttagccgcggggttcttctttatcctattataaagtgtgattatgtgcagacagttgagcaactgcctcttgtactcgtggatacgcttcacttggatgtcgaacatcgatgaggggttaattttgacgccatagtcttgttctaacagttgagccagtctgagtttattttcctgtttgactttcatgatggcgcgttggaagttggaatcttttgcaaattttttcagtttctgcagttggtccaaatggacagtccattcgtcgccgattttgtcggatatgagatcactcaggccggggttgcagagaagcaaccatctcctgggagtgattccgttcgtcttgttttggaatttttctggagtcaattcatagaagtctttgaacaaatcacttttgatgatttcagaatgtatcctggccaccccattcactgcatgagacccaacaatggacaaatgtgccatgttgaccctcttttcaccatcttcttcgatcaaagacatacgtctcattctgtctaaatcaccaggccattttctttgaatgtcttccaaatgaaaatgattgatttggtaaatgatctgcaagtgtctgggcaaaatactttctagcatcgtaacaggccatctctccaaagcttctggcaggacggtatgattggtgtaagcgcaagttttgacagtgatatcccacgctttctcccatggtaaaccttcgatatctaccaaaactctcatgagctcagggatggccaaagagggatgagtatcgttgagttgaatggctactttgtcaggtaagaggtcgaaatcggttctggtagcttcgcgggtgccaaacttcgctgccttgaacctcctgataatgtcttgcagggttgcggcacacatgaagtattcctgtttgagtcgtagctctttaccctcgaagaagttgtcattaggataaagaacccttgatatgttttcggccaagtttctgtcaagcacagcttggatgtagtctccatcattaaagaacttcaaattgaaatcaacaggggacttcgcagaccacaatctcagagtattgaccacgttattgttgtacccaggaatggggttgtcgtaaggcaaggcaaacaccacctgagtattgacccactttttaccttccggagtatcaattacgttgccgtaaaaattcacaggcaacatgtattctggtcgtgccttttcccaaggatttccgtatctcaaccagtcgtccggttcttcttgctgttcaccattaattattttttgagcaaagataccatactcatatctgataccgtaaccataggccgccatacctaaagttgccatagaatccaaaaaacatgccgccaatcgacccaatcctccattaccgagtccagcatcttcttcaagttcttctaactcttcaatgtccaatcctagttggtagagagcttcatccactgacgattgaattcctagattgatcatggtgttttggagagatcgacccatgtaaaattccagggagagatagtagaccctcttagggtccttctcataataatattgctgagttcttatccaccttgaaacgagatgatcctttaccgtgtgagctagagcaaaataataatctctggaagttgcaacatttctatctttgaccaaagtgtaatgaaggtgcctgttgaaagtctttttgatttcgttaacatcgtcgatttcagctattcctctgacacttatttgttttcttctctcgttatctgattttggggtggccatgatcactgaatactaccctccaaattcaaagaataagaacgttcactagcctactggctatcaccggctcacgactattattttggattagaggtcacctt

SEQ ID NO: 186 - DNA, 1806 bp, Leptinotarsa decemlineata
  Annotation=Putative ZDHHC-type palmitoyltransferase 2; Tribolium gene name from OrthoDB database=TC012534; Blast E- value Tribolium Gene vs. Leptinotarsa Unigene=1E-96
gacagattttggttatgttgtcaaagaaagttgtgtattgaattacttcagataatatttcaaaaggagaaaacagctcagaagttgaaatgaaagtgggaacaattatcaaatgagtgatgtaaatggggttttgtgctgttgcgagtattatgatttgaatcaggaacgaaatcatattttagcttgctgttgcaattgtgaagatttggatcaggccttcgataatataataacttcccatgccatttcacataaaaccaagaagggtattataatcacaatgcaagatagactgagaataccttggaagggaggtgctaagcaagtagcttttgatgcagtcatgcctgtatttatattaccgttaatgttacttatagcatcaatgagcctgtggtggactattttttctttcactacggtggcaatattcttagggttcatttctaactttcttataaaagcaattccgaggactaaattcttttttatgtggactttgacttcaatagttatattgtatataatatttgagtttattgtgatacctttcttagagatactcctggaggaaaacattgctctaagtatttttatatttggtttcattttttgcttgtatctgatgaaatctcgaacaaaaaatttatgccaagtaggagatagtgaagctgaaattggattcattgggaaaaataatagactacataactgttcaatttgtcagaagaaaattcctgacaaagaccatcattgtgtatggtttgactgttgtgttgggaaacacaatcaatgccttttcatatctgcactattttttgctgttgttgcattactttatagttctaacttgacgttgacttctgtttgccatccattcaaagtgtacaaaacaatattgttaccagatgattgttcagaggtatatatactatttgaattaggcctttcttttgtagctgctgtgtatagtcttattttagcctgtttactgttggtccttctgctgcaacaactagtattggtgtcattgggtataacattgaaagaatgggcacgttttcatttcacaacaaaattgtgtcttgggttgactgccaagagacaaaataatcggggatttctcaacaattggaaggctatcatttgttccagtaaatataattacagtcctactggtcatacatgagttgatatgattggtatttcattattaagaagtaaaatatatcacattgttcacaactattttcaaaacttttatattaaccaccagaaagtcttcgacaaactaggttgtgataagttttacttcaataaaatgtttttatccacacacctattaatacattatatatttacttaactgaaaaaatatgcagatatttattatatatcactaaatattttattactcttcagatgtgaaaagtaaattatttattttgagcacattgtcttaattctgtcatacaagtccaattttacaaccttcaattatctacttcccgaagtaaattatttggttacttttacgagacgattggtgattgaaaaaattaaagctggctacacttatcacaaattcaaagttacagagtctagctggccagctttcattacaaggtgaagataaagaaaccagaagaaagagctaacattaaacaaccacaactcccagaatattggtttacacagaaataactttttatctcctaaactatgtgccaaatatttgaacaggattgaagcagatttcatttatcatataaaagactcccaggcatccagatagtgaagaat

SEQ ID NO: 187 - DNA, 1046 bp, Leptinotarsa decemlineata
  Annotation=Sparc; Tribolium gene name from OrthoDB database= TC000930; Blast E-value Tribolium Gene vs. Leptinotarsa Unigene= 1E-146
ccgaaagcttcagaagagattctggaagaaatgatggaggctgaaaaggttgcagctgaacaagctgacgacgctaaaaatactgattttgaaaaggatgatgctgaaaatgctgtagatggagatgcaggttctgttggggctccccctcaagttgctgctcaggatttcattgacaacagagttcgtgtgttggatccctgcatggaagtacattgtggagcaggaagagtttgccaagtggattccgaaggagaacctcaatgtatctgtattccgagttgtccagtagaaacagaatcgcgccgcaaagtttgctccaactacaacgaaacatggacgtccgactgcgccatctaccagcagcgatgcttgtgcgacaaaggagacccacaatgtaaaggcgcgcaatacaagcatgtccatattgagtattacggagaatgtcgggaaatgccggaatgtaccaaagaggaaatggctgatttcccccgcagaatgcgtgactggctgttcaacatcatgagagatttggctgatcgtcaggagctgactcctcattatctgaacatggaacgtgaagcagaatctaacatgactcgccgttggactaacgctgctatctggaagttctgtgaattggatggaaacccaccagacagatctgtatctcgtcacgaactgttccccatacgagctccactcatggctttggagcactgcatcgccccctttttgaatacctgtgatattgataacagtcacagaatcaccattaaagaatgggccaaatgtctggaactggacgaagatgatatcgaagacaaatgtgaagatatcattgatgaagaataaaatgtattctttgcagaataaaatggtgctattaggttatgattggtgaaaatatatcttaattctggttggtttgaaatctttacccatcactgccttcgtgaaactgtaaaatacttaaataaggtaacaaataattttccaaagattcacatgctttatcatcgcaaactttattgtacagttttgaa

SEQ ID NO: 188 - DNA, 5227 bp, Leptinotarsa decemlineata
  Annotation=Myosin-IA; Tribolium gene name from OrthoDB database= TC005895; Blast E-value Tribolium Gene vs. Leptinotarsa Unigene= 0
gagtgttgtagcgaccgtgagttgtgattgttccgttcgtggtaattcaacaatagtataacagtcgcgttgactcatcagtcattcaagaattcttccatttcaataggaaatgctggatttttagtgcaaaaagtgaaacaagagatttggaacatggcaatgcaaaaagaagtcggagtaggcgattttgttcttatggacaaaatcgacctagacaatttcatgaagaatcttcaagtgaggtttcaaaatgggcacatttacacgtacatcggcgaggtatgtgtttccgtcaatccatacagaaccatgaacatttatgggcaaagtttcgtacaacaatacaaagatagagaacttttcgaaaatccaccacacatattcgcaattgcggatgcctcccacaaggttatgaaacaacagggaagagacacttgcatagttataagtggagaatctggatccggaaaaaccgaagcttccaaaattattatgaaatacattgctgctgttacgaatcaaggaggacaaagggaaatagaaagagtgaagaatgttttaatccagtcaaactccgtactagaagcgtttggtaatgcaaaaaccaatagaaacgataattcctccagattcggaaaatacatggatataaattttgactttaagggtgatcctattggtggccatatcaacaagtacttattagagaaatcgagagtgattcaccagcaaccaggagaaagaaatttccattgtttttatcagctgcttgttggggcaaacgaagacttactgaaaagactgaatttatcacgtgattccaatcaatactactacgtgaaacagggaaacgcttccaaagtagatactttaaacgaccgcaacgattaccgcgatgtcacttcatctttagatactctccagttcagaaaggaagaccatgacacattatggagggtggtcgctgcaatattacatttaggcaacatagaattcgtcaatgacgaagaaaaactcgtactaaagaaatccaaatgcgttgactatgtggctgatctacttcaggtgaggaaaaacgaattggaaactgccttatgcgaacgagtaattgcagcgaggggcgatattatgcgaaaggaacataccgaaacagaagcctcttttggtcgagatgcatttgcgaaagcagtgtatgacagattgttcacttggatagttgataaaatcaacaaggcgatttcagtggatcaaagtagtcaaaggtcgtattacaagagttcgctgataggtgttttggatatttatggttttgagattttcgataacaatagctttgaacagttctgcataaattattgcaatgaaaaactgcaacagctgtttattgaacttgtactgaagcaagaacaggaggaatataatcgagaagggattgcatggacaaatattgagtatttcaacaatcagataatttgtgacttggtggaagcaccacaccaaggaatcatttctataatggacgatgcttgcaaaatgacggcggagaaagtaacggacgaaatgttattagaagctatggataagaaactaaaagggcacaagcattatatgtcacgtcaggtgaaaccttcagaaaagaccctgagacacaaaacagattttagagttacacactacgcgggggatgtaacatactgcattataggctttctggataaaaacaaggataccctgtttcaagatttcaagagacttcttttcaattccaaggacagcaatataaaggaaatgtggccagaaggctcacaacatatttcagagattacgaaaaggcctccaactgctggcacactcttcaagaattccatgcaagctcttgtgataaatctacaaagtaaagagccacattatgttcgatgcatcaaaccaaacgaaattaaatcagcttctgcttttgacgaggaacgtgtgagacatcaagttagttatttggggctggttgaaaatgttcgagtgagaagagctgggttcgctcataggcaacgatacgataggtttttgaagaggtataaaatgatttcccatttcacttggcccaactacagagggtcagacagagacggctgtcgagcgataatggatgaaaataatttcaccgatgatgtcaaatatggaaaaacaaaaatatttatccgaactccgcaaactttgtttgctcttgaacatgcccgtaacaaacttatccctgcaatagtcaccctaattcagaaatcgtggagaggctatgtggcacgtgaacaatataagaggatgaaggccctcatgacgatgatcaaagtgtaccgcatgaagaaaatgcgagaatatattaccgttttagcaaataaatttcatcgcgcaaagtctatgaaggattacggaaaaagtatcgtttggcctgcgccccctttatctctgagagaaacaacaaaatccttgaggaagctttacaatagatggcgtgctcaaatgatactcggaaaaatacctcgcaacgaatggccgcagatgaagttgaaaataaccgctgccagtgcccttatcaacaaacgagctcactatggcttgaacagaagatgggaaggaaactacctctcgacccacctagaaaacaccaattataccgtcttcaatgagtctgtgaataatttgaggaacacaattcacttcaacagtgttctcttttcatcctatgttacaaaattcaataaattcaacaaagttgctgaaagaataatgctggtgactgaccagttgatttttaagctggactgtgagaagttccgtaatatgaaagaaggaatgtctttgggagatttaactggcatcagcgtcagtccaggacaagatcaattgatcgtgttacattgtttaggtggcaatgatttagttgtgtcgctccactgccagaagcaagaggataggattggagagtgtgtaggagtcatttgtgatagatattcccagatcaaaaatgcagaactacctgttaaagtatcaaaaaccataacatgttctcttggccgcaaacagagaacaatcaatgttcaagtttccgcagctgagcagaaagccaccttcaagaaagatggtaacaacattgcttaccttttgccttcaaatttcgctatcctcgagaatggcaacaatcacattaaacagtagacttatacaaaccacaaagtaagttgtacggtaatgatgtgtcattgcagtaaatgtgtctacaaatataaaaattctatgcaggtttaaaaaaaaaagaatatgaaggagtttttcttgtgaatttaatcgattaattgaaattattacagttttgaatagtatgtgaagcaggtgtacttaaacatcggaccgtatagtactttccatttaggaaataatagttttaacttattttcatttagcatactattggtcagtgtgaaattattcgttcaagatttttttcaaatttcgagtaatacaaatttattgttttactacaaagaaattgagggctttaagattttttggttgtataaagtattactagtgctatataatttattacttcattagttagtgattaattagtgatttgaaaagcaagtgccttccgttaatctgcaatattttcactagctttttttaatatttattttatgtacctatacatacataaaataacttaatttactatagcggttcagtcttttacaacgaaaattcttgtacaattatcaggaatactttttaaaaaaatgactagaatcgaagattctctagtttgaaattttggaaaataataggttttctgcatatcttcataagagtaaaaatttggttgttgacttgcatattttcagttgttttcattgacactttttcaaattaatccttgtcacccacatcactgttgaaaaataaattgaggcaagtcaggtaaaggttgttcattgatctcagacacaaaaatatatgggataaattttctttttagttttttaatgattccattagcttgttgtgaataaattgtaatttattgaattgttagagattttatttcatataggatttggcaaaattggcaaaattgttttctttaaggctgaaagttttgtaaaaaaattattcttgtgtattactatttaaacattttctagaatcgtttttttcaaatttatttcatgattgtaacatacaattgagaatgattactggatggttatttatggttttctattaatgtttgattcaattattggtttgtacttaattggcaaatgctatatttctagtatttatagttgatacattttttcagttgtgtaataatagcagaagttggttgttgatataaaagaattatgtttttctaatctaagaaaggatttatttgattttcatttgatttcacagagctgtaatatggatattttatttatattgtatattatgaatataaaaataattctaaacaaatttacatccccagagaaatcaacgatcattatgaagattcatttcaaaatttgatttttaatgagtcaaactgggattagaaaggacatgcggatagacaaataaattaatgatcagtttcattggtttgtatagtggagtgtttcaaagtttgaccaatatccatctatattgaattgagcaacacagttttactatatattttgttattgttgttgatttgtccaccatttcgaaaatacagtttcaatgtgaagtattggtgaggctgtatatatatccattagttcattattcattggaccccactggacatattactttgtgtccttcgggatgttctggactgccaggtcaaaatacatctctcagagttgtacaaggggtgtatgaaactgatttcatggtatttttatacgtcatttttttttcaaaaagaatatagtatttattatatgtttatatagtgccattgtttatattttgtgtatatattttcatacctttttaggtaccgattgtagtgaagctaatgtgccttaataaagaaagtgaagctttcatgaaatgttttattacttttccctatacaatttttaggagtaggtgtagaaaaaagcagaatgaattgaaaaaggacagacatttgatttttctaactgttaccaagtcattattttgtaacttccaccaaatgattttcaaagtgactgtc

SEQ ID NO: 189 - DNA, 1099 bp, Leptinotarsa decemlineata
  Annotation=Upstream activation factor subunit UAF30; Tribolium gene name from OrthoDB database=TC012018; Blast E-value Tribolium Gene vs. Leptinotarsa Unigene=7E-77
actcataaagtagatgtttcatatttcggatggtggaagggggttgaaacaggtagtcggcctctgtgcaaaatctgccccgatcggcccagtcgccaagctcgtttcgttcgtgttccttctctcttattgtgtttagtgctctcactctgacgacatggcagacatctcaaaagaggatcttcgcaaagaaattgccgccatcttaaaagatgccgacctgtcgtcgacgtctgccaaaaaggtaaggcaagaactcgaagagaaactggacactagcttgcagtcaaggaaaaaggaaatcgatgatttagtcatggagttcgtgagctctaagcaagacaagaagaagggaaagaagggagattccgataacgacgaggatgaagaagaagaggaggaggaggaagaagaggaagagccctctgaggacgaaaagaagaagaagcgttcttcaaccggaaagaaacctgcagccaagaaggccaagaaaggttccgatgacgaatccgccagtgaacagagcgatggggattctgaagaagaatattcaccgaaaaagtctaagccaatcaagacacgtaaacttccccccaagaagaagaagggttccgagtcagattctgatgaagattggggcaagaagaagggaaagaaaggcggtggcggaggagccaaaaaaggaggtggtggttacaccaaacagatgaccctatctcccgagcttgctgccctcgtcggacaagactcaatggcccggcatgaagtcgtaaagaaagtatgggcgattatcaaagaaaaagacctctacgaccctaaaaacaaacagtacgcaatttgcgatgatgctttgatgaaggtaattggagttaagcgattccggacctttggaatgatgaaatacctgaagacccatttcatcagctaagctgcattcgtagcgtgtacatttgactagcgccgtgtatcggcaactgttttttccccttccagatttgaatttcgtagtttggtgtccaacgtcgcgctagtcgagtcgatttcatgttgatagaattcaaatatttttttattattaagctatcgaactgatgaccat

SEQ ID NO: 190 - DNA, 1867 bp, Leptinotarsa decemlineata
  Annotation=LIN1-like protein; Tribolium gene name from OrthoDB database=TC004934; Blast E-value Tribolium Gene vs. Leptinotarsa Unigene=1E-55
gactgatctgatacgttgtgaacagataactgtagaaaatttgaggttcaaaaacatacaaaatcgcttgaaatgtctaaacgaaatttccaaaaggcatttctcgataatgaatcgaaatttcctgtagaaaacagacgtcaacaaattaagaaacatactctggatagtgatgaagaggatgaagttgatgaagacaatgttcttaatgttgatgatattgaaggtgaagaagaaggtatagctagaaaagaaggggaacaagtaatgactgcattcaatatgaatgaagaaatggaagatggtcattttgataaagaaggtcatttcatttggaataatgaaaaagaagttcgagacaactggttggataacatcgactggcataaaataaagagttcaagtgatactaaacagaagtataatgttgacgaacaggacctagtgcttgaaagtgactctgagcctgaagacgacaattttgatgaaatgaaatcttatgaaagtatattgtcttatttgaaacctaaggaaaccattaataaagcaataaagaggttggcaggcgctgatatgaagttatctagtgtagaacgactgaaacgtaaaaaagcaggtactttgaacgacaataaagatgttaccaatttaacagagcttgccaataaaatcctcaccaaacttggtaacatggacatttatcaagaaacttacgaaggcataaaagcaaaactagataaaaatgaaaagaaaagtaactccagagtaagagaacctgaacttgatatgtattctgatgattttgaggtcaaggaaaaggagaaattcgacgatacttcaaaaaaaggtgaacaaaatgattctaacgatcaatctggggagttgatgtgggagttcaaatggaaaatagaagatgaagaaatacacggaccttaccctacttctcaaatgaccaaatggtccaaagagaaatatttcaaaactggtgtaatggttagaaagtgtggagatgattctaaattctatacatcaaataggatagactttgagttatatgaataggcactttattgtaatgacttccaaaataaatatatacttatgagcatatgtcattaaatcctgtttgatgaaatttacccctgctacatgtcctcagacactaataaaaaattaagcttctatatcctaaaaatcaattaccaatgttttgcatggtatctaatttcatctgaatactttcaagggtattataaaactgcaataattcactttgatccatttcaatggtcacattttctttttctctctcattttttaatttggataatttaaattgtactcttgcaactggtaaactttgtttgttggagatttggtctgcacattgaacattcagttcccaggacacattttccaatttcataccattttcgaaatctccaaaatgttcattagttttgtttgaccaaattttgacaaactcctcagctttttcggcattgaagccaagatgttctatcaactgtttttgcagtatcgaaggtttcatcataactttacatgactgcttgaaaatatgagatattgcctgaactagtaattgcaaagagtcttcattaagtttgagtgaagttctgagcttttccaattcttcatcagtgaaggggttttcagtttttgaatttgaaatatgagtaagaagtaactgtaaggtctttgttgtaagggaatttatgagttgaacaccattcaacaacttggtatttacagttatccatttgacttccatattagaaattgattattttgacttgtgttttcagaaactttatcaaatattatgtctataccacaagtatacact

SEQ ID NO: 191 - DNA, 3179 bp, Leptinotarsa decemlineata
  Annotation=Rootletin; Tribolium gene name from OrthoDB database= TC000358; Blast E-value Tribolium Gene vs. Leptinotarsa Unigene= 0
cgtcaataaattggagcagaagattgaggaaatcagaactgaaagggacaattgtcagagcgaagtggaaaatttgaagatccagcttcatctgtgcgaaaataaaggagaaagtgtcagtaatcaattgcacgagacaattaggaaattgaaagaagctgaaaacaactcggagtctttgaggaaagagttgacagatgtgcgaaggcttctagcagatggtaattcgagaaggagaagtatcataataccaataaagaactcagggaccacattaagagaacagagagcgagaaaagggaacaagctagacaactggaagaagcctacaaaacaatttcaaaccttgaagatatcaaagttagccttgaaaatgaacgaaaccgactacaaaaccaaataaggaacttggaaacggaacaactccagatcgaacacaaagtacaaagcatccaagaagaattacagcgtagtcaagcttccaactcccaacagcaatctgaagagaaggaactacaagctagacttttgaatgaagttgaagaacgggaaagagctcaccaagaagtacaccagcttagaaagcagatatcggaattagaacgtaacttggagcaaacccgacaagaactaagcaaaactagagcacattcgggtcagctggaagagcaatggcatgcccgagaacaggatcttctagtgcacttggaggacagcaaagctagagaaaagcgactcgaagatcagaagcacaacttggaagtgtgtttggttgatgcgacacaacaaatacaagaattgaaggccaaacttggaggagcggaaggtagggttagagctctagaaacccaactggctcaattggaatcatcaaagagggatatagagcaaaaattgagcagcgttgtttcaactcttcggcggattgccggagttcagctagatggatctgtcacgatgccttataggctgctgagtccttcaaggagatggagtccggctcgaacatatgaagacggtcgagatggatctatagatatagatccggaagttgtccggaaaggcgtgagaaatttaatgcagcaagtagcacaaattgagagggaacgagacgactacaaaacacaagtacaaacgagcaagaagcagcttcaagaggcccaggaaaatcaaaataagggtgacaataagctgagtaaagttttgcagaacttgaggattttacaggaagagaagagtaatttggaagcgaaactgaaccagaaaaatgttgaagttcagtcacaaacccaagctctcgagaaaaagagtgaggaagccaagcaaatgagagaaaaagttgtcaacttagaactcacattgagcagtggtaatgaagagaaacaacaatacgaggacaaaatagaaaaaatgaaaatggctcttgaacgacttgaatgtgaaaagcgtaacctacaagaagaacttagcagaactgaaagcaggtcaaccaaacttgagcttcagcgaatgtcagcagaaggtgatttacaaagattgcagatgatgttacaagaaaaagataataacatacagaaaatacaagaaaaatgcgagaaacaaagtcgcaccattgccagcttggaagaaagatgcgtttctctaaaatctaccatcgatcagatgactctatcgctggaaaaggcttctgctagcgagtctgaattgaaatctgaattacagagtttacagagagcattgatggaaacgacttcggcttctcaaacgagcgctgaaagatttaaacagttgcaaaagcaattggccaacagcgaaaacgaacggcgtgttataaccgaaagattcgaagccactcaacaaaatctcgctgaaatgaggaggaataaccaaattcttcaagatcaagtgtctagactcaataacgaactggcgaacaacgaagtgcaaagatccggtttagaatctcaattgagattagctcaatggccgaccgacaccaccatagcgtcgcaccacgaggaagagctgaagaaccaacttcatgcgtgtcaacgggaaagaaacgagctgagagccaaggtcgactctatgaatagtaagttgcgccaactagatgcggaaaatcgtaacttagaaagagccgcgtccaaggtacctgcaggggttagaagcaagtcgtatgagcgtgagcgcccggaaaaatacgaaacagaatccgccacaagcgagaacagagaactgagaatgaagatttcgcgtttggaagcagaattagccgaaaaagacgccgagatcaatagactgaaaagtcaaaggcaacctctggattcgaaattcgacagagccgaaatcgagagatatagagcggctcaactccaagctgaaagattattggaagctagggaacagagccatcgacagcaagtagctagattggagaaccaggtaaccctactacgagaacaactcaaccaggaaatcaaacggagacaacagtacgttctgaggagtaccaaagccggtagggagatgcagcagctgaggcaagccctgggcgattcgttgcgaacagtatctcaggacccttctttggacgctctacttttagagcacgaagcaagaaaactagataacacattatccaacactgccagtttgccaccagcattagctttaccttcgtcctcgtataggaggtcgacgacgccacaaccaaagtagagagtctcgtagaagaaaggtatttttactttgttacctacatatacgtaccggtttgttgacagtcaaaaagtttcctttacgtaattacgaatcacttgaagtataatttgcaccaaaggttatatatttatagcatcaacattaatgtatttatttcagtggtatagtttttgtttatattgataggaaacacaaattcactgccatttttatatttctagttcatacagaatgaaatagataacaatttcatcaacatttattacaactcgattatttcaatttcgtagttagttccaaatattatatatcaagtgtgtattttctgctaagttggttgaagtatttctttttgctgatacaatttttaggtgaatttaatattaagatccgtccatgtgtttttatatatttgacaaaatgtaagaaagttaagcaataaaaactactataac

SEQ ID NO: 192 - DNA, 2444 bp, Leptinotarsa decemlineata
  Annotation=protein prenyltransferase alpha subunit repeat containing 1; Tribolium gene name from OrthoDB database= TC011467; Blast E-value Tribolium Gene vs. Leptinotarsa Unigene= 5E-127
gggttcctaagcaaatgtgtgtacacgaacgtcataatatgggataaaatcaaaaagtgatgaaaaatgtttcggaaactccaaaaataaatttatctatcatgagtttaatttgtctttatttgcaagatttttttgtgaaaacaaccgaaaaatggctgaaggcaatgatatggctattagaattttacgttcaatacatggtattttcaagagagattcagaacccgaagaattcgtaatcattcccacagacgacaacacaaagaacaaatctcctgttttatatgagcagcgtaatcttggcctagaatcatggtgcgttaaacttgtatataattatgcatctttggtgctgctagacagtagggaagccctaagaagaggaaagttgcctttctcgaaaatggaagacctgaatcacttactgataggagcacttctcataaatcccgatgttactactttttggaatatgaagagggatttggtggaaaaagacattctggctgtggaagaagaactgtattttagtaaagttgtcttgactcgcaaaagtaaatccaatgaagcttttgggtatcgacgttggttactgaaaaggattctagataaaatggccgcgaacaatttacatattccattggccctgttgcagaatgagcttttcgtaactaatttggcgtctgagaaatctcctaataattatcatagctggaaccatcgcatctggtgcttggagaacatcgtgcccaagaaccaatccatcagcaacatcgtctactcggaactgagctacagccaggaatggatcaacaaccacgtgtctgaacacgccggttatcactacagacagtatctgataaaattagtgagagaccacaaaaaaatcgtgaccctgtacaattcctactacaacttcgtagtgaaaacgctgctgaacactacgaatgatggggattgcagcaacttgcttacttatctctttggcaaagcgaacaaaacgaagttcctcgaagagatatgctcgtacgtgaactacgtctgcatcctcctctacgacctgtgcgtcgtcgtcgacaagctgaacaagctctatccggaacacgaggctctgttctgccacaggaagtttctcatctacagcctgctgaaagttcctcacgaatatcacggcctggacagctctccgcgacgcgagcttgacttagagtcgttccgcggcagcccggcagacgttgaagaaaacaggtggccgaaattgtttaagcgctcgcccagatgcgagctgtacaacgtgtacagcttggtgtcgacgtgcgagaagaatttcgcttcgcagaattgtagcgtcatgcagctggacaagtatcggaagtggctgacgcatgtggtgggtttcgagtgaggttagggtttgtttgagtagatgcagatgttgtaatgacgcgacgatggatgttacagatacgcctgggagtgggcggggcgaggaggtctatttggagagtgtggggatttttttttgcacgaaatatcaaaattcaaaaagaagaaacacgaataatctctcacagaactttttttttttttaacaaaaaaatttcgaatcgataatcatcgagtcccaaatgataacgaggggtagttatgtatcgctagtgaagtggtgagaattttgtcaatcgttggcacaatttgtggataggcagcagcgtctacaattattttagtgtgacgagatactgtcacgaatttccttaagttaatttgtatttgatttttcagtttctcaacatataagaatgaccattcaatttcgttagacgagggaccctcactttgatgaactaaaatagtttcctttcattcatacacttgaatatgaacagttctagtattgtcaacttttccaaaactcacaaggtctgccgtattcatttccaattcagtttcaagcagttcagtttcgaatttcttattccgctggtccagtgatggggagaatcatcatatcagagataactcggaagaagacagcagtggctgtgaacagtgtaatccaatgtttatcaaacacgaaatggttgctggaatattcaaaaaaggatgcatacatgaaagatatcaatactagtatttctagtatgaagggttctttaatcaaagctcccgcagaagttatcaagaaattgtggtcagaagattcatctgatagagtagtaaacacagcctccttaaaaagtcagattcaatgagttgcccctcgtttcatgggctacgcccttcaagacgtccgagagtttcgttgatatctttaagaaggtttatatgaggaagtaaatcaaaatcaaaaatactttattatacatttctcttataccaaatgttaggtctactgtacagagtatttacaatatttacatctctcccgcatacgggag

SEQ ID NO: 193 - DNA, 2014 bp, Leptinotarsa decemlineata
  Annotation=Mitochondrial carrier protein; Tribolium gene name from OrthoDB database=TC014295; Blast E-value Tribolium Gene vs. Leptinotarsa Unigene=2E-138
aacatattactttatttttaaaatcccacagcacacaattcaattaaaaacagaggtgttctacacaaactaacagataatgaaaatatatttcctgcaatccatcgaacataatcccatacagagcgcaaactattgtacatctcctttattaatgaatgatgagctcaaaaatcatatagcacatgtaacaattcactgaatgaagttatcagcttcaatcgcatatttctaagagttccttttatagtattttgaatctgaaaacttggatcctagatatttctgctttcaggattcaaatattcacattagacattgaatgtcaaacttcaccgttcaacagaattcattcaaaccttcagttcatcatcgagaaaataaataaaagctataaagttacaatactctgataggaacattaaaaatattgtaaatgacgaaataacacgtaaatagaaaaataaaagttgactattttcgcaattagattgccatcggcacgtaaacgattctatcagtgccaatatataccttttgatcctttacaaaatgcctgttgtgcttgaatttctggccaatatttgctttaaaaaaaattatatatattggcgtggaattcaaagcaaaactctgcttccacacaccatactgcaacacctttatgcttgttacaccaacacaagttgccaacactaggaaatgaacttgagaaaagtgttgcagttctggtgtataggagaagtgttttcgagtgtcagttatttcttagttactgcttatggcattttttttagatattctgtcagacatccaatgaatatccaccggatatccaattcatgtccggaagccaccattttggacgaccataatggactgactcgaattggatattcattgttgtctgagttgcctctattggtactgaaagacacaaacgatttcgcatatttggctattcattttcctgttccattcgaaccaacacaaatctggttttcctgcaatatattgtcaaagttgatgcgttaggcataaaccacctccttcaaatgttcataagctgtattcattaccccccagctcaagaaagccctggtacaattagtttgaacaccgtgataaatataacgaattttccctcccctttccctgtatatcctaagtaaaaccacaaacggattttcgtaagcccccccaactttactctgcatcgcaattttcaagacgttcaaaggatagcaaatactagacaacaccacaccgatcatagccccacacataaattcggtcaaactgcgaacgaattcgttttcgtatctcggcatccgcctctgaacctcatccctcactatgaaaaatccgacgttggacggtccgtttcgcaataatataggagtcaaccctcggtaatactccccgaatccgtagctccgtacaacctggaaggcgtgcagagtgtttttcaagtctttgtggtatttggcatcggcgagaagggtctgaattcgctcgaaaggcattaaaatcgcctctgttgttcccgaaactaaagctcctaaggctttagcagtgtactcgttgaaaccaatttccagaagaggccttctcacttcttcatatacaccaaacattatggacagcgagcaagttttttggcagagaggaggcagcattcctcggtatagataaaacaaaccttcgcttcttagctgcgaaaatgcttgcccgaccttgactccatgaagcatctgtcgaaaaatcagtttatttataggataggttactgttacgtttataaatgctgccccccatccgcaggcaaactctttccagtttattccacttgggagggccaaatcagaactgttcatttttgggggaatatcacatttggtttcgtatttaactaatatttacattatttcatcacataaattttgataaatctgtggagactgaacttgaacacacatatggacatagctgcaactccatcttatctgttact

SEQ ID NO: 194 - DNA, 1908 bp, Leptinotarsa decemlineata
  Annotation=WD40 repeat-containing protein SMU1; Tribolium gene name from OrthoDB database=TC001051; Blast E-value Tribolium Gene vs. Leptinotarsa Unigene=0
acttataaatataataagcaaagagtacacaaaccacaaacaccaacaataagcagtatcacattatacgttttctgtatcagtattttgtctagtttggagttaggggggcacaagaacatttctgaataacaacacttgaccacagatttcctctgtgacttgactggcactggatgttagtagattttggttataccaatgataaacgatattaatttttattttgattattgtttatagcttattgctctgtggttagtgtccagaaaacaaaagggaacgaaatatattacttgaaataatctactatcttttggaaaatgtctatagaaattgaatctgcagatgttatacgcctaatccaacagtacctaaaggaatctaacttattgagaacattacacacattgcaggaagaaactggtgtaactctcaatactgtggatagtgttgatggattttgcgctgatataaacaatggacattgggacacagttttgaaagctattcagtcattgaaacttcctgacaaaaagctgattgatttatatgaacagattgtcctggaattgatagaacttcgagaattgggtgctgcaagatcattacttagacaaacggatcctatgataatgttaaagcaaaatgaacctgaaagatatatacatttagaaaatctattggctcggtcatattttgaccctcgtgaggcatatccagatggaagtagcaaagaaaaaagacgtgccggcatagctcacgcactatcaggagaagtatctgttgtgccgtcttctcgtctcctagcattactcggacaagcattaaaatggcaacaacatcaaggtttactacctcctggaacaactattgacttgtttagaggaaaagctgctgttagagaacaggaggaggagacatttccaacacagatggccaaacagatcaaatttggtcaaaagtctcatgttgagtgtgctcgtttctctcctgatggacaatatctcatcacaggaagtgttgatggtattattgaagtatggaacttcacaactggaaaaatacgaaaggatttgaagtatcaggctcaggaaaattttatgatgatggacagccccgttttatgtatggcattctcgcgggatagcgaaatgttggtgacaggatcccaagcaggaagagtgaaagtgtggagaataagttctggacaatgtttgaggaaaattgaaaaagcacactccaaaggtataacctgtttgcagttctccagggataacagtcaagtgttgagtgcatcttttgacaacaccgtaaggatacatggattgaaatctggaaaaactttgaaagaattcagaggacatacctcatttgttaatgaggtcattttcactcaagatggacataatatactgagtgcttcctctgatggtacagtgaaggtatggagtataaaaacaactgaatgtacgaatactttcaaatctctcggagcaagtgacagtgctgtaaataatatccataattttgccaagaatcctgagcactttgttgtttgcaataaaacaaatacagtggttctggttaatttacagggacagattgttaggtcttttgctagtggtaaacgtgaaggcggtgactttgtgtgttcaactgtttcccctagaggagattggatctactgcgttggtgaagatatggttctgtattgcttctccactaattcaggaaaattagagagaaccctaaatatacatgaaaaagatgtaatcggtatatcacatcaccctcatcagaatcttatttgttcatatagtgaagatggacttgttcgtctttggaaaccataatgtgtttatattgattaaaataatattaaaaaaaataaaaaaaaaaaaaaaa

SEQ ID NO: 195 - DNA, 554 bp, Leptinotarsa decemlineata
  Annotation=Transcription factor XBP-1; Tribolium gene name from OrthoDB database=TC012878; Blast E-value Tribolium Gene vs. Leptinotarsa Unigene=2E-44
agtattgcatcagattcagaaaggaaatcacataggaacacccagcccagaagatcagtttcataccgtatagtaaacagttcagatcaaccttctattataaaaaagattaagtgacaagtgtttactaaaatacttttggtctcaagtttttcaaaacagtaataatgactgctatctctgcgatattgaaatacgtggaattgaataatcagaattaccctctggaccaaaataccgagatatcagagaggcccaaaaagagaaggctggaccacttaacatgggaagaaaaaattcagaggaaaaaattaaaaaatcgagttgcagctcaaacatctcgtgaccgaaaaaaggccaaaatggaccaaatggaaaatgcacttcaacagttattttctaaaaatgaaagtctcatcgcagaatgtgaaaatctgaaattggccaaccaacgactttctcaagagaatttggatctttacaatcgtctgcaatcaccttgcccgatatgtgcaaactctcagaatcgatctgttgagtgtgaggcccttaat

SEQ ID NO: 196 - DNA, 4028 bp, Leptinotarsa decemlineata
  Annotation=Subtilisin-like proprotein convertase; Tribolium gene name from OrthoDB database=TC009181; Blast E-value Tribolium Gene vs. Leptinotarsa Unigene=9E-157
gagtttgtgtgttgataagttacggagtgtgcactgttttcgtctgagtgatgtggactcgcacatgtgatgaatttaaagttcagtgatactggcagtttcataatttacaagtagtataatctaccatgatttttgccagaaacaatcgataacgcctttttatttacccatcagtaacgaagaacaatccagcaaatcatttcggtttcgattcagtccttcgaaagagcttcaacatttgaaaaacagtgaaaacgtcttcttgacgttagaggatgaagagattttattttttttgccttggtgtgataatttgcagtatacgtaacacaaaagcacattattctcaccagtgggcagtacacattgagggcggacccaaggtagctgatgaagtagctgaggatcacggattcattaaccatggtctgatttttgataatcactatcattttgtgcacagaggcgttgccaaacgatcaatcagacctaatttggagaaaaaaattaggcttgcagttgacacgcgggtgcgctggtcagagcagcaaaaagttaaaaggagagttaaaagagacttacaggtacaagatagtgatccgaaatggccatctatgtggtacttgaaccgaggaggagggttagacatgaatgtgataccagcttggaaagaaggaattactggaaaaggagctgtggtaacaatattagatgacggtttagaaaaagatcacccggatcttttgcataattatgatcctatggcatcatatgacgtgaacggtcaggattcagacccaagtccacgctatgacatcatagattcgaacagacacggcacgagatgtgcaggtgaagtagcagctaccagcaacaactcagtttgtgccctcggcattgcacacggagcacaagtaggtggtgttagaatgcttgacggtgatgtaacagatgctgtagaagctagatcgcttagcttgaatcctcatcacatagatatatacagtgcttcctggggaccggatgacgatggcaaaacagttgatgggcctggtgatctggccaagagggcattcgtagagggagtgaaaaagggccgtaacggaaaaggctcaatatttgtatgggcttccggaaatggaggaagagaacatgacaattgcaactgtgatggttacacaaactccatatacagcctgtccatatcaagtgcaacggagcatggtcacgtcccttggtacagcgaagcttgcagttccacattggcctctacatacagtagtggggctgcaggtgaacgtcaagtggtcacgaccgacttgagacattcctgtaccagtagccatacaggtaccagcgcgtcagctcctcttgctgccggaatttgtgcactcgctctagaagccaacccgaatttaacgtggagggatatgcaacatatcgtagtacgtactgccaggccgcacaacttggtcgcacccgattggcagaccaacggggtcggaaggaatgtttctcacagttttgggtatggtctgatggatgcctatgccatggtgcaactagcgaagaactggattacggttcctgaacagaaaaagtgtgaaattaccgcctcctctgctgtaaggcctattcctgctaaaagtgtgtcagtgatacatttagaagtcaaagaatgcgagggtgttgaagtcctagagcatatccaagcaaaattgaccatattttcgcaaaggcgcggggatttaaatattcagttgacttctcccatgggaacaaaagtaactttactggctcatagagcccatgataactccagggcgggttttaccatgtggccctttatgtcggtgcattcttggggagaatctccttttggaacatggctgcttgaaattcacaatgatggccgcctcttaggtgaagtaaaattctggcagttaacgttatatggcacttcgacactaccgtccgcagaaaaacagaaatttaaagaaaaaaacacaatacctgaggttttcagtgaagacattatgcacaactctatttatgattctttgtccaattgggaaggtggggcagaaaatcgcaaggatattttggaggtagaagaacacgagaaaagtacatcaggttgtgcgaaaaccaatgggaatttatgtttagaatgtcttccacatttccaactctacagagaaacctgcatacaaagctgtccagagaaaacttacaacatcatcctggatagcggcgacagtttcaacaaaaacttgttagcaaaccaaagttgttcttcgtgtcactacacgtgtaaaacttgtctaggatcccttgattcgaactgtgaggagtgttacacagacgctaaactagtacgtacctccagtaccgaatcgtactgttatcctgttcatctgatgtcggaagtcttgtcagaaaagtggtattacagaatgtttactatgatgtacattttagttgttgttctcatactttcgacggttatctatttatttgtgaggagaaggaagtatctacaaagcaacctcgctatgtatggtaatgtagacatgaagcaaagtatggacttttgataaatgaaatagtagtataaatggattttttacatctcagacatagaaaatcacgtacaattgtaattatgaaaacttttttggaactgataccaggttgatattttaaagaaaaagttaccaggttgtttcaaactagtaggtgtatggaatgtacctattttgtattgcatttgttgttatagaataataacacaatgaaatgtggagggaaggtgacattttttgtaatatttagacgcaaaaagtatcctacaaaggtacagaaacgagggaggaatacatttaaattcagtttcaattatacaggtcggctcatgacatttcaaaacagattcttaaaaattttcattctctgtctattctaatactttatcaattaaattcaaggatgcccactcaaattaaaactatttttcaaaaatttaaatcctcggaaaggtgaatcaaacactagcttggttaagttaatgtacatacatcaataatttgcagaaataagttttattttcaaaatttgactgataaaacattggaaaaagcctaatgaaaaatttaacaatcattaagttttgccaaactgagctacctattactgaaattaaatacaatattttttctctgaaatattggaaaaaatctatatattattgaacatcttgtcaccctaaattaataatcatcttgaaggactggaaaattataaatctgaataccaaaggactaagttcatgtaaatctgatgggatacatgtcagcagaagagagaaatggtgaattgctcatgcatctctgtaactactaaacaattttaccttttgggcgctcataatctctcttcggctcattaaactatcataatgagatgcttagaagttaagtgtaatacatataatttgatattttatcatttaagaatagatgcactatatatagttggtaattttttaaattaaattaatgttcatgtgtatctagccatatacatatccaatattacgaatttcatgttcctgggaaatatgctcacaattagtttaggtatcacattggtgatgattgtcaaaatataacactagcagttttttgctgaatgatgataccctgttgttaattatacccacattaaatggtaacagagctactgtattggtggtttacattttgaaaattctatggtcttttttattttcaaaatctttcggaatattttctgttgaagttctgaaggtataaaatgatatgggttgttatcatctatgttaattcaggtggaattcattcctggtagttgaacataactatcactatttcagatgtttattcaagaatctactcaattattatgtatatttagaataaattttatttttataattgtatagctacatttatctgaccaaatgtgataaataaaattattttact

SEQ ID NO: 197 - DNA, 1240 bp, Leptinotarsa decemlineata
  Annotation=FRA10AC1; Tribolium gene name from OrthoDB database= TC002084; Blast E-value Tribolium Gene vs. Leptinotarsa Unigene= 5E-98
gtatttataggttatgctataggatattgatgtttggaaagttgttttaaaaatttatttgtaataattatatcttgaagatgacatctttacgacatcaaatgcgatatctgaatccctacgacatgcacaaattgttgattaacgaatacattttgaatcgacccggagatactaaattgctaaaacgcgacacttccaaagatagaaatgatcaccatgttatcagagataatcataagttcctttgggatgaagaggattcaacagactcttgggagctgcaatttgctagacgctattatgacaagcttttcaaggaatattgcatcgcggaccttacgttctacaaagaaaacaaagtggcgctcaggtggagggtagagaaagaagttgtaagcggcaaagggcagttcatttgtggaaataagaaatgctcggaagaggatggactacgaacatgggaagttaatttcggttatgttgagcaaggtgaaaagaagaatgccctcgtcaaattaagattatgtccaaagtgttcaaaaaaactgaattatcaaagtaaaaagagggaagtcaaacgcctgaagaagaaaaggatcctcccaaaggaaagcaaatctagcaagagaaatgttcttgaagataattgctctgctaccagtagtaacagtcttttatgtgaaaaagaggaggaagatgaaagagatattgaagaaagttcggacacatcagtactgttaaatgaagagtcgccttgggataagcataagcctgtcgaaagtaaatcaagagatgaagaaatggaggaatacttgcaagacttgttactttaagttatttttttctcactaagaaagattattaaatactggctctggcagtttattgttgtgtttttgtatataaatcttgatttatattggaggcactatagtttctaataaaccagttacaaacatagtttactaaaattttagtgttgtgggttattagttttatcagtttttttctcacaaatgaactcttgcttagcatgtgtgatacttgggatgttaaaaatgttactttcatgagaaatagattgaaatgaatgaatgccctcgtcaaattaaaacgatgttgttgtatacaggattatgtccaaagtgttcaaaaaaactgaattatcaaagtaaaaagagggaagtcaaacgcctgaagaagaaaaggatcctcccaaaggaaaacaaatctagca

SEQ ID NO: 198 - DNA, 1128 bp, Leptinotarsa decemlineata
  Annotation=Co-chaperone protein HscB, mitochondrial; Tribolium gene name from OrthoDB database=TC014961; Blast E-value Tribolium Gene vs. Leptinotarsa Unigene=2E-55
gggaatcagctgagaaacgtcaaatttgaatgttggcaaatgaatcaggaaaggagatttcaatattttcgttaaatgttttaaaataatagagtttaattgtggttctacagctaccaagctctatatctatcaagattgttatctgttgcccttagtgccaaaatgattttgaattatgtgaagtcaagacatttccatgtacttcagctcagtggatttcttttccaatacttcaaatcatataattcagtgaaactgattccacaaaatcttggaattattcggattacgccaagtttctccacagtgggatttaatgaaaaagtgtgctggaaatgtggagctaaacgaaaaattgccgaattattctgtgataaatgtcatgtaatacagaatccatctgagaaagaaaactattttaaactgtttcaaatagaagagcaatttagcatagatgaaaaattattgagggataagtttagaaaaattcagagtgtcatacatcccgataaattcagtaacacaactcatgaggaacaaactatttcagaagaatattcatctttaatcaacaaagctcacagtaatctacagtctcctttgaaaagggcagagcacttgcttcaactgaaaggacaaactataagtgagggacaaaccgtggacaatcctgagttcctgttagaagttatgtctcttaatgaagaggttgaagaggcagaaggtgatatcaacaaaatgaaagagctcaacaaaaaagcaaaatgaggattgaaaacattttacaaagaattgatgattgtttcaaaaataatgacatcgaaaacgcaaaaaagaatataatcacattgaaatattactgcagtattagcaacagaataaatggatccttgagagagttgggagtatccgagtaaattttaggattaaaaaaaagtgagagatatgttttacatttcactacaattttattgtatatcatttgtacaggtcaagttttactcaatgaataaaatgttttgcacagaattctatttgtgaaaatatttcttcacagtagtttccgaaagacgccaaaatgctattgtataacgaaacatgtgttgcgttgttgaaaattttcaa

SEQ ID NO: 199 - DNA, 2113 bp, Leptinotarsa decemlineata
  Annotation=Kruppel-homolog 1; Tribolium gene name from OrthoDB database=TC006630; Blast E-value Tribolium Gene vs. Leptinotarsa Unigene=3E-43
caaatatcaatttatttacttgtgtaattcattaacaataacactgatgatacaaatacaatatacaataatttatgggttccactgatttcgaatgaaatcaacagctcagacttagaattagcatacaagttatacatacgagttttacatcataaagatcaacatataaaaacaatagaaaaacacaactacacttcacactagtactttccgctttggatgaaatatatatactaaatacgagctatcgatagaaaatctatgagatgattgccaacataagacgaacagcgtattgcgaaggcctaggcactgccatgaggtaaaacgttgatttcaaacagtcttatcacagaaaaaaaagtcattgcagccattcactgaaccaaaatatgaagcttgataaaatagtactaataaatatttggtttgctcgatcaagttacgacgctctggcgtaatggataactgagctgtatctgacaggtgacaagtccagggtgctctccatcgacttgaggatcatcctcgaccgctttcgaggagggaggctgagctctggatcgggctcgggaaccggagaaaccggtggagacagggaagaggcgggcgatacagggctagaattgggaggcgtaacagtcgcctcctctgtggactggtttgcttctaccgccaacacagcctcgacccgtcttctgagaccatcgccagcagtgaggggtgtagtgtattgcacagctggcgaagtaaaataagcagggtgtctgttgttcttgatcaggttgatcacatcctgcgtgtttctatagatgtcgtccctctctgtggcagttgccgcagctgccagcagctcaacgccactagagggcactgtgtagttgtttatgtggtatgttggagacatcctgtctcttgtggaactggtgtacacgatgtaacggatgtcggaatcatagctgacgggtgcaggttcctggaacattggtctcggagagtcttttaggttgtccaagtcgcttgcgctcgaacaagatgactcggaggtcgatgatgccggtggcgtgggaggctggggagggttgctttcggaatggcacttgatgtgagtctctaagatcttcttcgagttgaaggtgtcattgcagatggtgcatttgtagactttttctccaaaatgtgccacctggtgaagtttcagcacatggttatatccaaatgacttcccgcaaatctcgcaagaatagggtttttccccagtatgtgttcgagtatgcactttgagttgcttgctgcaggtgaaacccttttgacacacagtgcatacgtaaggtttttcacctgtgtgggtcctcatatggatgaccagctgcccggactggatgaaagtcttaaggcaaacggagcacttgtggggcctttcgccagtgtggatacgattgtgacggtgcagctttccggagtgttcaaaagctctagaacaaacctcacacttgtatggtctttctttagtatggattcttctgtgcacactgaggttctctttgacgctgaagctcttgttgcagaactcgcatctgaatggtttctctcctgtatgggtccggtaatgcctcgtcagtctagccggcacagcgaaagtcttggaacaaatgttgcacctgtaaggatcctcagtttccttagcgtgagtgcgagcatgggtggcgaatgcagctttggaggtgtacatcttgttgcagatttggcactgataagtttccgaatcggattgtttggttatgctgaaatccggactgcagacgagtttcttcactagatcttcgcttgatgaggtacgaacttgtgcggtcggtaaagtagcctcgctgtagaagccgaccatttcaggaagggcccaaacttcttaacttttatattgtcgtaggacacagatgttgttcaactgttcataataactagcgattcaattaaagtttacgtacaatcactacagaattgagttccgatattgacttgacgaattgtaagtcgacttttggtattgcaaaaatttttgccaggggtattatttttcagaccaccttttgcatgagccaaaatcaaactc

SEQ ID NO: 200 - DNA, 1399 bp, Leptinotarsa decemlineata
  Annotation=Coiled-coil domain-containing protein 76; Tribolium gene name from OrthoDB database=TC004062; Blast E-value Tribolium Gene vs. Leptinotarsa Unigene=7E-157
actgacataacctcatatttcatgaaatatttcaatattgataactagcttctcttttaaacgttaaacccatatttttggcttccacaatggatgatattcccgaagaagtgtcagaaagtaatccaaaacgaattaaaacttctgaagatcatgaagcacctgcacccagtcattgtaagcactttgttaaaagaaaaaaacggtattgtaaaatgaccgtgaaatttggagaagagtattgtggtgaacatcaagaaatttctccagaactctctagtaatgaaaataaagacaagaaccaagtcagaattccttgtcccttggataataaacacacttgctatgctcgaaacttgaaaaagcacctgaaaatttgcaacgcaagacctaaaaaagaagagccattcataaatcgaggaataaattctggtgtggaaccagaagacacagaagatgtccacaaacttctgtcgagttatccaaccgaacagatacagaaggttatagccaaagtaaacgaggtgtacgagaagacgattcagaaacggttgaatgaaaaaatttccaaccacgaagtagtcgaagaagaaatggcaaaaccagagcatggagataagtcaaagaagcatttgacgcaggtgtcttcgatattggggcttttggacgaatacgatttgatgaaacctaaaacgtgttttattgaattcggcgctggtagaggccagctgagttattggatagccaaggcgtgtgcctctgacaaagaatcttccatccttctagttgaaaaggcgtcaccaaaacataaaaaagacaataaacttggtgaatctgcagagaaggtgtgcagaattcgtgcggatatatctgatcttgtattagacaaattagatataataaccaaaacctccaatatcgtgggtgtcaccaaacatttgtgtggacaagcgacagatctagcattgaggtgtatggctaatgccgaggaaaaccgtgaaaaagttggtggatgcgtaatgacgttttgttgccatcacagatgtcgatggattccttatacaggaaaagaattcttcaagcaaaacgacctcagcagtgacgacttttatatcgtatgcggaatgtctagctgggcaacatgcggcagtggtctaagtagggaaaaacgaaaagaggacctcttaatacaggacaaagcgaacgaaagagacttagtaattgggctctccaagtcggagaaggaagaggttggtaggaggagcaagagtgtcatcaactggggacgactgactttttggagaaccgcggcttccgctgtcatttgcattactacgtggataaaagcataacaccggaaaatgcctgtattgtcgctgttaagtaatataaacccgtt

SEQ ID NO: 201 - DNA, 2799 bp, Leptinotarsa decemlineata
  Annotation=Cyclin-Y; Tribolium gene name from OrthoDB database= TC013890; Blast E-value Tribolium Gene vs. Leptinotarsa Unigene= 0
taaaaatatgagtgaaacctcactttttcaaacacacaaaatatcttggtgtaggaaaaacagttgaaagttggaggttccaacgacaaaatgggaaataaaaacagttgctgttctttctctagtcctgagagcagccacagagagagagtaataattcctattgaagacacattgcatgaaggagaaataagccataacaatctacagcatattagtgaaagggaaggcgatgatggggaagctgatccttctcaggaccccatggccaagacaatattcattgaaagatccaaaacagcaatagaaaacggtatgataagaagaaagagccaacatcaaatagcagacatgaggcctttaaaaaaaagtagttcatgttctacgatatatctagatgatagtactgtgtctcaacccaatttgaagaatacagtcaaatgtgttgctctagctatttattaccatatcaaaaacagagattctcacaggcagattgaaatatttgatgagaaattgcaccctctcacacgggaaggggtgggcgatgattacgacaaatacaaccctgaacacaaacaaatttacaaattcgtaaggactttattcaacgctgcgcagttgactgctgaatgtgccattattactttagtgtatctagaaagactgttaacttactctgaattagatattcaaccatctaattggaaaagaatagttttaggtgctattctactagcttccaaagtttgggatgaccaagcagtttggaacgttgactactgccaaatattgaaagatataacagtggaagatatgaacgaactagaaaggcagtttcttgaactgctacaattcaacattaatgttccttcgagtgtctacgccaaatactattttgatttgcgcactttggctgaagcaaacgatcttacattccccagtgagccgctaagtatagatcgggcccaaaaacttgaggcaatgtctagggtcatggccgacaaatacacccaacaatctataaagaatagtctgaagaaatggtccagtcttgacaatatcacaaacggatctgctcgaaggagtgtagctatcttgtcgtgattaaggatttatgtttccagtgaagttctgcaattgattgaagagataggttttgggttagtttctttggaatttcgattgaggtgtttttattttgtcagtggatttgcagattattcaatttcgtgggtctttttaaatgaaggtttttaaaggaattactttgttgtttcgaggttcaacttgatcatttgaataattttctaatgataacacgtggcagtagatacaaagtagatatctgtctgttaaaatctgttcttccggtaaccagcggtccccccccttaggaacaacaactctcaaaaattgaaacttatgcgagctaaggactaacgagggcttaccttttaacgtgcgattcttaactcttagtagttttcaaaatgattcacagacttagtcgacaagcaactgatgttatcactatcattaatacacaaatagaagctaccccacttgacagcaatattttatccgatatcaggactactgcagttttttctattgacattttttagaaacaatgaaatattcaaagtaattaatgtgtttagtgggaaaaagcaatatttctcatgcatatcattgagaattcgtcctgaatgttgctcattcaaatttttgaggctgcacaatatttccagtcaatatttgtaggcatgattttctgtacactaaaaaaactatttggtgtaggcattattttgtataaacttcaaaaaattctatttggtttttaaccagaattggtaatgatgtaaaagttcccacgtatgcccctaatttagtataagagtcattgataaacatgtttttagttttgtcagcaggctttactatctcctgatttttacagttttcaaattgatcgctccaatttgtttacttattgcctcaacctcaaaggcttactcttcagtctatcagtgcttcacatgatctaccaaagtattcctagtgaatgatttcaataaagatctactttttatttaaatattatgtattttgtatacaatattatttaccgagcttttcaagttaatagatgtatttttatactttataaattcatatgaatatttatttatatcatattcatttctattaatgattgtatgtttaaacttatgtctttcaaagaaaagacctgacactgctcttttgaaaaatagatctggattgaattggttgaaacatttatcagaacatgtatatttagccgtgccttcaactttccccaagccacttattatcaatactacatataaaatgactaatgttcagttttgagtaaaataatataattttcagtaaaacaatacaaatgagcaaatttggagaaaatgtcattttgctaaaatcatcatatcatgcctgaggaagctattgtttagcgaaacatgtgttgggcttttgtaaatggctcagtgaaaatgttccgatgaactgcttgtgagttttcagcaaaaaggtattgccatgcattaaaattccacctcaaatttgaaccgcagacttagtacaaatccttttcagattatactatccaagagttgtttcaaaaacgcttaaaacccgcactcatgcatatgtactataattgcgacaaagtttttaaaatttcaccaatataactgaccttagcattcttgctctagccatgagaaattttgttcaacatttgaattg

SEQ ID NO: 202 - DNA, 1325 bp, Leptinotarsa decemlineata
  Annotation=Bhlh factor math6; Tribolium gene name from OrthoDB database=TC005579; Blast E-value Tribolium Gene vs. Leptinotarsa Unigene=1E-68
gagtgcagcacgtccccttacataagtcagtcggtcgcatacactcgactgtccaatttaccctccagtacgagtgaatttttgtttttgtttcgcacttagtaaattgatgtgccataatagtttgtcgaaaaacttctagtgctgtgatattagccttttttgtttttatgggattatgacgaatggagattttcgaaaattgcacgtgaaagatattgaaatggctcttccaactgcagaagacatgggattctgttcgagcgaagagtatttggaaaacgacatccactcgccaactgatagctccgatgatagcgtggaagtcaaagtttccgccatctccttgaacaataagagaaaattgccagagtccagaaaatcatccggaactttcgcgggacccttgaagaagagaatgtgcctgaaagtcaaagccgaaattagcgataatcatcccttcagaccttggagtccctctcccaacgaaggtggagaaaagattagaataaagaacgaagcttccttctcagtgccatcaccaaacagtgtttaccaatccagaacacagcccaaactggaacctcagtttgccccctatttccgacccccttctcctatcccgttttatcaacagaccgagccggtttctctagtgaaaaaacgtgaaaatgtcgataccatcaaagcagaagaaagtgatactagttctcaagacttgcgtgtacctatccacccccagatccaaaacctttccacagtggaaactgaaagaatgattctggaatccaacgaggtgtttccttcgttgcaagctccatctacaagcggcagcagtaagcagtccctcgagagccaaaggagagagcagaggaattacaagaacatgactagggagaggaggatagaggccaatgcgagagagaggacgagggtgcatacaataagtgcggcttttgacactctcagaaggtctattccctcgtattcccacaatcagaaactgtccaagttgtccgttttgaggatagcttgttcttacataatgacgttgtcttccattgttgatgaaccaagcgggaatgagccttctacttcggagtgtgtagatatggtctcgaagaccattcagcgagaggggaaattgaggaaaaagaaagatgataatgactgaaagtgccaaattttttttattacctatcgagttcctaggttttgaatctattccagtttttttaagctgccaaatcctgtttgtacttatgtgtataaagattttgacaaagaatatttatttgattatttaataaagaatgtcttttatt

SEQ ID NO: 203 - DNA, 1885 bp, Leptinotarsa decemlineata
  Annotation=Angiogenic factor with G patch and FHA domains 1; Tribolium gene name from OrthoDB database=TC009165; Blast E- value Tribolium Gene vs. Leptinotarsa Unigene=2E-143
tttcacgttattgtagtagatgaaaatatctgcgctagatttcttaatgtagtgtcggtagattgaatgataatgtgtaatgtttgctggttttaaggagttttaaacataacgaaaatgaatctacaatgttctaaaaatatttttaatatcgtattataggaaactatatattttttctttaagtaaaatgactgataaagcagatatcccaagagatgccaaattctcttgtgaagatctttttcaagcagattccgattttaagtacaaatcagaaatcgatcccgatttgaaagagacattgaaagacattccaggcgctctagagtacatccagaaactggaaaaactgatagtaaagcacctgaagaagatagttaaattgaaaaacaagctgaaaaagactgataaactcgtagatgtttttacacaaactgatttcgaagcagacacagaatatacagtttgtaattctgatgtaggcactgagatgccagttggtgagccaaaaagtttggcagacgatatcaaagacgcagctgaaatggctatgaaaaacactgggtttgtctatgaagaaacatctggaatgtattacgattataatacaggatattattataatgcggaatatggactctattatgacggttcaacaggaacatatttaaattacaatcaagataccaagtcttacgagttccattctcaagtgagcttacaaccagcagagcaaaaaccaaccagaagaaaaaaacgtaaaaacaaaaatggcagcagaaataaagacactaaacgacagcgtggggacgaaaattcgcactcgcccaatagggattttgaggagggagaatgttctgacagcggagggatttcttccaatgatggggctgactcggattcgagcgacatctccaagcagtggcccccctgcatgcgtgtcatcgtcgaatcgaccgacagttccaagctgaaggagggttccctgcacataataaccttcgaagggggcaccttgggccgcgagggcagtcactccatcctggtgcccgacgctagcgccagcaagcaccacctcaagatcaccttcgacaaggacacgggcctgttctacgtcgtcgacctgggctcgagaaacggtacgctgctgaacggcaagcggatatcgccttcgaagcaggagagtgaaccaatcgcagtggagcatggcagcaggctgcagatagggtcgacagtgtttctgtgccacgtccacgaaggaagccagacgtgcgggcattgcgagccggggctgattcaagccaaggttcccgaaaaggaaatagtgacgacaattagcagatcagaaaggcacaagaatgagttgaaaaacctgaaaatgaaatgcggagtgggtgcagaatacggggaagaccccaaattggcagccggctatacagacagggcccaaaaacggagggaaacagttggcagtcaaaacccgcacgaaaaaaccaaggtggcatcgttagatgagtctatagataaggaaaacaaagggtttaaactcctcgccaaaatggggtggaaagaagggcagtctttaggaaaagacggggaaggtcgtttagaaccagtgaggccggttgctaatcaaggaactgctggtattggtagtaacgaagctcacgtgtcagttaaggtccccaacgagaaacagtctatttggaagaaagctcaggaaagattcgaaaagttaccagcaactagtgatgctttcgaggaagatttggctaactgaaattattttacttttgatgcatggttattttcatgtaaatataatgatgattgaactgttaacatgtataattgtattgttgaaataaaggttgtgaggcgg

SEQ ID NO: 204 - DNA, 1599 bp, Leptinotarsa decemlineata
  Annotation=DNA polymerase zeta catalytic subunit; Tribolium gene name from OrthoDB database=TC004938; Blast E-value Tribolium Gene vs. Leptinotarsa Unigene=2E-121
atttcatctagatctggcatatctcttcctgctttatttgttgtcactactttaatgaacacagcttttttttctcagttttcgtgctggggaatttttgatattaacagaacagatgtcattattcttaaaccccctctttccatatgaaagatactcttcagttgtcaagttcttcataatctcttcactttctccatctaattgaggaatgagagtagtattccacatatcatcatcacttccttcaaagttatcattattagatgaaactattttatgaggagtcgttactgcttctaaaggcatactgagatctaaatctttctcctcatcatcttctttaactacttgagtcagtatgctgtcttctacagcatcctctcctaattcattcaacaattctaaaagattcaaagcatcttgatctaaagtcatattaacatcgatgtctggagatggttttgttgtttcatccaagtcattccaagaactgtcattcaaactgagttccaagctagacggagtttcggactctatcatggacgcatttttaatagttaagttttcaggtgtttccgctggatatactgatgagtttattttttcaacaatattcctttctgtagataacatagataatctgtctctcaaagcctgtttatacactgaatgtgactttgttggctcaatatgtgttctgtttaattctaataaatggtcaatttgtgaactctctcctttatttcttcttctctgctgttcatctgcccaaagagatgaaattcctggattagctgctatattgcctgaagagatctcttctctatttactatattttctgccaaacaatccccttcaagttcacaaactgtattttttataactgttgctgggagaagatcttccgcattaatattttgagatgggttatcaggattccttctgaattttatttcagataccaccatgctactcatgccatgcaaattgaaatcaatcataaattgtaaagtgaaattcaaatgggcctcatggggttgatatagtttaccaagagtagattcattcattaaaagactggcgactttgcgaacaagtaggggattatacaaatatattttaaaaaactggtgctcccttaggtgatacccatacatgggtatgcctttaaccaaagttattttatatacatgttgagcattggatgaagcttgtttcaaagaaatattaacagctttatctatactagcagcaattctgtacatcaaactatttgcttcctggataccatcataaggaatataaatgtagggaaaaacaccgtgaatgtgaacacaaattttttcacctgttggtatagatccaaataacctcaaaataggaacttggtttattgaagatcctctaaaatcagaatacattacatctagaccttgaacaggagcactcatacaagaatccaaacttatgattctaacagaatataacttcattgttcaatttatttgataaaaataataaaaagtttttataaaaaatttcaaacaagaatattccaaaaattagatctacttttgactttgacattactacca

SEQ ID NO: 205 - DNA, 2633 bp, Leptinotarsa decemlineata
  Annotation=Deoxyribonuclease tatD; Tribolium gene name from OrthoDB database=TC009977; Blast E-value Tribolium Gene vs. Leptinotarsa Unigene=7E-144
gaatcacaacaggttaatagtagtagtagttcatctcacagtaatgaaattaattttcctcaccaaaataaatcaaaatatttacagttaactcaggtttttatataaattattactagaaattactcatctacgaatattataaataaattatataatatggcagctcaagtagaactcacaagtactgaaactgaaatggaaaaatgttatgaaaactatattataatcgatgttggggccaacttgactaacaaaaagtacagtagagatttggattcagttgtacagagagccaaagattcaggtgttcagaaaataatggttactggtacttccgtaaaagccagtaaagaagctttaagactcactaggatatatccaaatactctgtattcactgcaggaatacatccgcatgatgccaaatcttatactgaagaatcctgggaggaattgaaagagttagctagtaatccggaatgtgtagctataggagagtgtggcttggattataacaggaatttctcagaacctgaggatcaaagaacggtattcaggaaacatattgaacttgccatcgaactcaagaaacctctgttcatacacgaaagagatgcctatgaagatttaataaaacttttagaagaatttaaaactacacttcctcctgtgctcattcattgcttcacaggaacctctgaacaagcacttggatatctcgataaaggattttacataggactaactggttacctttgtaaagacaaatcagatacaggcgtgagaaaattactagaggatggctctataccgttagagagactagttgtagaaacggacgcaccatttatgtacccgaacactcgtgcctcaaaattgccaaatcatgttaaagaaggcttgacagaaaggtcgctgacatttttgcatcgctactgtactttccaaagaaacgaaccttgctctttgcctgccatagtcgaaatgatcgcgtcatttatgaagaagaagccggaagaagtggcgctggctacttcattcaatgccatgaaactgtttggactgtcgtagtcctatcctatttattcatacaacgaatgcatatcaaaatagaaccctgcaccattcttacagcgagtagtatcttgttgaattgtctgaatgtttttgtataatgtaggtatatgctcgttacaagttcggacttcctttgcctaaaaagtcgttaacagatttgaaatttcagaggaacaaatagaatgaaaatgaatgaaatgttaaaatcaatggaatcactaaaaattacctgaagaaaatattcgggcaagttagttaaaatcattaagcaattagtattgaaatttataaaatgtaagaacgctaattagctaagcaaacaaattattgtgacccgaaaagaaaatgcattaatacctaaatgggtcaaaagtgaaatgtgaataatatacagactagaaaaatgaaatgaaaataaaataaatggtgaaaaatgcaaacaacgttccaattatcagtatccacaatcgtcttcgggattagtggtttccatatcttgcatatttccacactagcctagctgaatgggtcgttgtccaatgtgttatgcagcttcagtgttttttttctgtgtatgatttcagcttaagaccatttgatgtcatgttgacaaatttttaaactcattgcttgtacttatttctgtattttaaataagtcattggaatatttaggttccgtaagttttagtattttcagaaattctaacattatattcattttatttgtttttttaactttggacaaaaagttattcttcaccaaaagtttcaggactaaaacctaatacgcaacaatcggttatcaagttctttcagtcctatacgaggtttgccaagggatatgaattttgctcaagagtaaagtaactcttcaagacaatatcgaaaattttatacaaaacaagatgatcagaattgaaaattacattacaatatgcgcgattgtaatactttataataaaaattaggtttttaatttttacaaatatatattcactttttgaatgtattttattttcatttaatgtttattgaaattaatacaaaagtgataacttttgtttcttgatgttttctaattattttacatgtgtaataattataattgaatttttgttattgtagagaactacaatacatttgtgtataatttataaataacactgtttgatattggagctgaattcatagtttttgacacatctcgtgtatgacggaaagaagttgataattgatgataacattttcggttttagttcttgcagaacttttctagaagttttctatatggttcctacatattgagatatactgtatattttttaatgatgatgcctagtacaaatcacattgtaaaactagttctcgagctgaatagtcttgaatttcactagttcggacttccattgtctaatatataaaatgatttgaaatccctgaaacaactaaaaaaagaagaattaaaaatgaatagctgaaaataacaattatattaaccaaaataaacctgaaatgaaataatagtgaaataaaatacaagtaaaaatagaac

SEQ ID NO: 206 - DNA, 5897 bp, Leptinotarsa decemlineata
  Annotation=Transmembrane protein 145; Tribolium gene name from OrthoDB database=TC003142; Blast E-value Tribolium Gene vs. Leptinotarsa Unigene=0
gagtatatatcatgaaataccatattttcaaacaaaaatgtataaaaattacattttttcagtgataactgttttaatttattcattcatacaaataggacagtgcacgcacttgaaaggatccttcaaatctaacgatttttttaaatttttgataaagttcgggtttcaaaagactgatcatcatcaagcagaagcaacccatggatacatatttggaaatatcacttccaaaaattccttcgtgtatcctattacttttgctgttctggatagatcatatttcttagattactacaagaacaggggcatatataacagaaatgaagcttgcagacgaatgtttcatactttgaaaactaggacttatgatagtaaatgtagtgttgatggaaaagattatctaagaaaggtaccatgtcctgaagggaaactttgtgaagatgaagacaatccatggaatgttgttagcggtcatcaattcacttatgtcatacaagactttaagcaaccatctttttggtatgtttctatggtggcttgttttcataatgccacctcttgtgaatggcaagaatataaaacctacacaccatatgaaatagaatatgatatttggctcgtgaatggaaacccaaacaactctgcttatagtacactcacgtatcaattctcttttgatagacagaatacattagaactctacattttgttttggttgtgctacatggtccttgtgcctcttcagtgtcatgcagtgaaaactcaaaaacatccagttacaagattatttactgctagtttgttattggattttgtagccttgtgtttaatcctaattcatactctaaaattcgctttggatggagaagggtttccaaaaatggcaatgaccggagatattttcgacattttatccaggacctcgtttatgcttctgcttcttttactagccaaagggtgggctgtcactcgtcttgaattaacttggaaaccactagtttttgccatatggctgggatatggaattgtacatatattactatatgtttggaatttgactgaagttgatataattgaagatatagatgaatatcagacgtggccaggatggttaataatagtgttcagatcgttgataatggtttggttcttgtatgaactacgcacaacaatgttgtatgaacataacacacaaaaactgaatttcttgttgcattttggtgcctcaagcttagtttggttcatctacttgcctattttagctctgattgctcttcatgtttctgctctatggaggttcaaactattattaggtataacttactcagcagactgcttcgcctactgtgttatggctcatttattatggccaacacgttctgagcagtatttccttctgaaagggccttcatcggccgacctagaagaactagatgaattcaacgaagctcctcacattgtgaacaactcctacacttctatgagtagcataaattcctatgagatctgtaaatatgatgatccgcagaaaaccaaactcatcaatgcttaggctgcacaatgagcttatgatattcttatgaaaaattggtactgtaggtttagattaagataaaagtgtgtttgtgtaggtaagatgttggtgtcttaaatgacgcaatgtgttattagttttttaatatttaattgtatgaatctgagagaaaatgttatttttaaatcttttatatatgtaacaatttgaaagtgcttgtatgctttaagtaattgagtttattccagttagaaaaatattaggtttgttttgggtagttgtgcttgttgagtgaatattttattctttgtatcattttttaaatggatctctcaatagtacatcttagccaataaaacctgtgatacaaataattcacagcatctccatacatgacatcagaatcaggtcaatttctaaaaatctaaagttgagaaattcatgatgtgaatcactgaaacctattttgttttcagatagattaaattacaagtccctgataaactatgaatgtgatacaagtcaattcatttttttttatatctaaagcagtggtgtgctgttcttaccttaagctttcatagttcacttgacaagctgtgtgaaaattcattggcagatattcttgactgatattgaaatgataaatgcttttcctcactttgcatgaagtagactcatactctaattttgatgaatcccatagtatttccactgtttttccgtccatacattttgtataagttgtatcaggatatatcacaataggttcagtatcatgaatatttgtccaagttatgtagtgaaaatttcgaaactaataaactgaaaactaaaactttgacagtgtaaaacaaagttggtcaaacattttccatgcaaaaagtaatattacgaagtgatagatttcacctctcactatggatgagattaaccctattacatattttttgtggtaaaacaaaattacctcaggaaggaattaatgttatcataattgggaaatatttatcctagaaaatcaagttattggtacatctgaacggtatttatacattaccaggtaccaatatttattttatttatctgaagtaaaataaaaactagaattgaattaatcaaatggaaagatatgaaaaaatttgttcccccgaaattgcaagtcaattaattattgaaccatttttaccacacagtattgcattctaagtttcttctctgtgacaaattttgttcattccagcagaaaaaacttacgcatgaaaggaaattcagatcctttctgctgaatttgtattttcaactatattaattatcatattctacacttttccgtaatgatatagatttcctaattttttatttgctttaagttttgtattgctcaaaaagggtatgtgatgaattatagtttttatattagttttttatgattttaatatatgtttgtaaccttttttcctttaaacatgtaaaatgagtggtaatttgtgccaaggtaaataattacctcataattggggaatttaacattatgtgtacctacttgttacttatcgatagtctttgcatttatgaattacaaaaccttttttttactggtgatttttcacaaaaaagcgttttaagaatagagtttacaagttttaaaaaataaatcctcgttctgatgaataatgtcatttttgaattagttcgttagtttttcccccatgatgatttaaccatttcaatagataattgaatgaaattgactgacaaaattttatgtcttagatagaattgaaaatttaagaaatgaaagaagatggaagctgaattttcatcagtgttctaaatgtatattgattattttttattctctagacacaattgtgtgtggtgggttagtaataattattctcgaaattgcttctaagtttaggtacccttcagttaatttatcttacatagatattagttctatcaatatctgatctttcaccgtcatatttgcaaaacatgttttgcttcagaagtttactatcacacacttataatttttgtatgtaatacatgctgctttagtgcatctcacttaggttgacacattccattcatagtgtccataattttatctgtctgtataaaatatatttctccgttaaccacttatgaatatactgatccattatcttatgaaaattaataataacagtatccatgataatggaaacagtaagtttcctgactaaattggttaatagtaaatgagataataggtataattttcaaaacaaattacaatctcggtttttggacagtacgtaaattttcaatatgaataaatgtaatggcattatgaaaaacggtttaacaatggtgagtggttaacctcttgttggtcgttcaatagggaatttgaatgtttggccttattgacttcagagactctagcagattcaatttctgtcctttattttctatatgtagtattaaaattgtgattgttttccaaaaggtggcactcataggtggaattggtcttattcagtttcaaacttctttatattcattgattctcattttaaacttttgggcatgatccgtatgttagtttgtagatatctgatatgttatccttgtctatgtgtaacttgttaatattttgtttattcagtagtctttttattttatctgtttttccagtatgtgggagtgtcttgaaggtaccagtaccatattttatgttccgccttttggagaacgatcacaatctcaacaccatttacgacattctacatatagaaaataaatgacagaaattgaaactgttggagtctctgaaaatctgattttgttaagagtgttgcacattcatgccatagcgcgatattccaactgtaattctcaataggtacaaaataggtgcattaattttgaatgttcctttctggatgacagttttactccatgcatattggttccattatcatatttatgacctctacagttatccagctaaatgccctatcacacacaactatttaaattatcttctgtggtctttttggcatcgtaaattttagttgtatattaatgaagttatcgtataaatatagacttttttgatattacgaaaatattgccgatattgttcatatcatactttttaaaaattatatattgtattatttatatatcaaatcattatgggactttggatgattttttcattgttgaatttaaagaaagaacatttactctaatactgaaattaaaaaagtataaatctttataagaaaattgtcattaatttttttttcaacagcactttgtgaaggaactaattccagacttattaataaagcaaaagtaatagtaaatttttggtttatggcaaatttaatctcatgaaattaaatactgaaactaaaaagaaacaagactgataatgaaatttacgagtttgataattacatattttcatttacaaaaatgtatttccatttagtacagagtgtctgacagctaactttgagctaggcctaaatatgtgtcttttcctcatttttgttttgcataatcaaacactaacaaaagaatggacatcgaacatcggtgaccaatgattgattgatgcaaaccatcgaaacaatcaaatgaaattaaagcttacagatatttcaaaacacgagatcttcgctagaaataataatagcacctactttgtttgatgcaaaatatgaataactacaaaaatcctttttctctcccattttgattgcaatgttcttactgacaaagaggaaagagatattgacttcacatatatgttatttgaggtagaagataccttatggagatagacgatttttgatttttcaaatatatttcttattgtttttttttttcaatttgtttcttgaatactagaaagggaaggttttgaaagtgatattctttgggattagtacaattgtgtaaatctgtttttgattcgacatgtaccaaaaatacagtgtattttgcgttatttgctcggcttgagtaatttatgaggaagaaatgtaaataattaatggtatttatcaaaacgtatttttgtgaaaaatcaccattattctcaatttaaaaatatttctaatattatattacacacgtaatccaattaatacacctaattgtctcaatttagatgaagttggagaattgtccttaaaatacatttacaatgtttacttttatttttcgttttaacatattttctagtgaatatgaaatatttttcattttattattctcaacttcatctagactatataatctgcacatttgttaaattataattttatattatccaataaaatatttactaacg

SEQ ID NO: 207 - DNA, 1749 bp, Leptinotarsa decemlineata
  Annotation=Suppressor of fused, putative; Tribolium gene name from OrthoDB database=TC000485; Blast E-value Tribolium Gene vs. Leptinotarsa Unigene=4E-19
agatgactatttcttttttaattcaaatccacttctacgagaagaagattataaggcacatcagatatatgtatatatgtatacaaagtataaataaatggacgacatatacggaatataaaaaataaatataaaacctactactcacgatatgtagacaataaatacaataacctaaactatcaagcagccttgatactctcatcagaaggtccgatttgcacatcccacatttcgtcaataaataaataaatatcctaacaatgtcatactttatccgccacaatggtaatcgacagcttcctgtcaggccaggagaacgtcttgggtaacgagagagcctccggggtccccagagcttgaaacgtgacggccatatcctgagccaagtcgacgggtatcaaaacttgcagccaagagccctgagacacaaacggattttcagcatcgaccagagtgcccgtcaccgaatcggctaccagggttatcgcggtttctcccaggacggacttgaatgtgaagtggcgaccgtgtctaactcttcctcttatagccagaggaagtaaactaccagcttccaaattaaacacaagatgaaccccctccagttttttgagatgcatcagttctgccgactcgagaaaattcctgcttccttggagtgcctgttgtacgggggacttcaacctaaactcgtcattttgatcatctccgtgatctttcaaatgggatatatcgactttcgtaggatcctgctccacccacgaacacctagcactgactccgctcagattcgaaccttccctctcgaaacctgtctcgacttcatcatgagcattcaaatcaagttcgaatatgctttctcctcgcctcatgtccgttatgtgccaaggaccaccggccgacggtaacctggatatcatgttcagaattccggctccattccattgttgtgctgctttcagttcttcagagcatattccaacgatctggacaaaatccacggttccaaaaggtgtgtgagctgtattcagctgcaaatcggtggtcatcagcatatgttgaattcgagattcgctgttatctagagcacaatgccatgacacgtgatctcctgaacacaggctgttacctgactgaaacacatattttgccaaagactgcataagcgtagctggccatgttggaggtgccgtttctcctggttctcttttcagcctaaaactaagctcgaaaccaaacccagataccccttctggtccagatatatcatgaactctaccatctccatgcagatctgacaagccaaagcttatatagtgccaatgaggaggaatattctcgtgtggtattccaggattggcatacatagaaatgtaatccaaaggatcaggacctcccagccagtattttaataatgctgtcacctgcagaggattaacttgatctggatatatttttctacacagagaatacagactctccaatcctgcaggggtaggcggaagaatgttcataggaggtccatgaggaagactagcagcagcttcctccatcatcaattatcactctatttttagagtttcaaaaggaagtaatccacacccacacaatttttaattatcttagagaaattgaaattttttggagttcgggtgattgttaaaaatgttagaatctataaacttgaaaaattggaactttaaatgaataaaaaatacttttcagaaatgtaaactttttggtctc

SEQ ID NO: 208 - DNA, 1865 bp, Leptinotarsa decemlineata
  Annotation=Eukaryotic translation initiation factor 4B; Tribolium gene name from OrthoDB database=TC011031; Blast E- value Tribolium Gene vs. Leptinotarsa Unigene=8E-71
tacaatgaaatgtaatttatcaaaacaaattacaataaaaaaattgcagcaaagattatacacatacaaagagttttgtattttaacaaaaaatatatttctatcactaaaacaataaatatgtaaaatacgtatgattaccacttacattaaaatttttattttattacatatgaaagtatgtacacctctacaatattcacaagaaacagttagtccaaaccatcttcagggtccaaatatgcgaatttattattagcagcaaaatttggtggttccaattctgcaagttttggcatttccttctctggtttgtcccttttctcttcacgcctcggtttgtcagacctctcacttctatgtctgttatcagttttatctggtgacctctgttcagtcctagaaggtcctcttttgtcatcataatttctcctcggtggtggaccatctttattatccctatctcttaacggactattttctattttacgtgaaggcctgcttctttcaacatcttttttatctccatcgtctgaactaggatattttttatcaggactactttcccttggcttgtcggaatgcccctttgccaatttctcttcaatttccctttctctctgacttgtatctacaggtttggcgctaccaaatatcgaagctgaaggcactgtctcagttttcacaggtaaggtttccactggtttcgatctgggtgccagcatcaaccttggtctctcacgcggttctggtggagcattttctgaatccctatcatctcttcttgtaaagccatcatttctatcacggtctctatcattatcatatctcctcgaaccatatcctcctcttctgtcatctctatcatcaaacctattcctatcagaatctctgaaatttcctctatcagaatctctaaagtttcctctatcggagtctctgtaatttcctctatcgcgattgaaacctctgtctctatcctggtctctgttcctctctccattcctccaagctcccggcttatcatcgctttctctggcactcctaaaattatctctgtctctaccgtggtctctgtcacgcatattttccctgctgaaacttctttcttctctatctccgcctcgcatattgtccctattaaaacttccgccgtccctgtctctagtgaatccaccaccgtccctatctctattgtaactaccgcctcgcctatcattgtcgttagtttcagttcggggacctgaccgccagtcgccaaaagattcgcttctctctcctcggtcacgtcccatttccatgcgtcctcctcttcggcggtcgttgtccatgttcgaagcaacttctatcctaatccttctatttttcaatgtcgtatcaggtaaaacaagtgcatttaaaagactgtctctgtcctcaaattctacataaccataacctttagattttgcttctccgcctcgatcatccttaggaattctcatatttgctatcttcatgtccctaaagaattcggcaatctcatcctcatccacatcataaggcaaattggataggtaggcagagtacggcggatctttaggaaccttgtcagttatatcgtcataatctcgagaggcttttggtgctgtgggtagcaccacgttgataggtttcctgtcatacccatcataatcatccacttcatcagcccagttgaggttggattttctgataggttgaacaggtatagatccagcattttcctgcagaaagtcgttgaggttcaaagttttgcctttggctttctttcccttttttcctgaagccatatttccacggaagaaataaatggcagatattgaattgcgacgtgtagggaagaa

SEQ ID NO: 209 - DNA, 3234 bp, Leptinotarsa decemlineata
  Annotation=Labial; Tribolium gene name from OrthoDB database= TC009463; Blast E-value Tribolium Gene vs. Leptinotarsa Unigene= 4E-1; Blast E-value Tribolium Gene vs. Leptinotarsa Unigene=0
aacaagtaccaggtagagatgggagaagggaactacttgatatctccaacagcaggtgcatcaaacgcttgtatggagtttcagcaccttcataagtataaggaggagctggggcctggggaagaacattctagacttcggcagcaccatggaatgcatggtttgtcgcccgtttcgattcctcagcctgttttgccgacttacaagtggatgcaagtaaagagaaatgttcctaaaccctccgcttccaaactttcatcgcccactatgacggagtacccaaccagctccccttcggccctcaacatagaaacccaaaacccggcttcaaggaattcctgcctgggctcaaacacatccaatcttctgggcctcaattgcctgaacaccggaagaacgaatttcaccaacaaacaactcacagagctggaaaaggaattccacttcaataaatacctaactagggcgaggagaatagagatcgcttcagcgctacagctcaacgaaacgcaagtgaaaatctggttccagaacaggagaatgaagcagaagaagaggatgaaggagggactgatacctcccgaacctgctttgaattctggaagcaatagcaactctccctcgtcgacgaatgttctccaaaatgagtctgttacagggagcaatgagaacagccgtgaatcgaattgagcttttaggttaggttacattttaaatgattgcattttggaaaattgaatgtatttcgaattcacccaaagttgtctggtataacctggttttgagagaagcgtctgttctgttttgaaagtagccaaaaaatattctttacatgatatgcaaaaatttagttcaatcagctctgatcttttcaccctaacaccctttcgaaaaccagtcataacctcaaatctttttgtattaacaaaaaaacaatttttagctgatggtttacaataagtcttgatgattgtgagccaaaacttcaaaggtaccgtaaaaatgtaatacaagtgcgtatctccattttaataatcatggtggctggttcatgattaaataaaattggtgtttaatgaaagcaaagaataataatgagtgtaaagaagttgcactcaaaaaacagtgtaagaactttcagtggattttgtttccatcgtagatgaccagagtccagagttttattcgcgttctcagaaatgattccatggggaggttggagttgatttgagtttcacatctactacgaatatatttactattctcgaaagttttggtggctactctaccatcctgatgtggtcactcatgatcttttttaaacttggggatgatcggatgatctatagtactgaaaggaaatttgaatattaggcttgagaaaaccagtcaaactttctatcagcaagttttttcaattcctcaactttcttttcgaaactacttgcctgggtgactgttttgactcggatttctttcttccggggtcgctgtttaaatgccactgccaatgtatttattcctgtgaatattgaactggaatagcttcaccacaatgccaatgatgagagagtctagtaatatttttaccacgaggtatcaggaattgtttttcaaatcattttaaatattagacaatgaaagtccgaacaagtgaaattcatcaagaatgaaaggtccactgctaacaccagaagcttcacatgtagaatatgaaaagtttagcgtgcggctttataatacaattttagtattgttaaatacaacattgagagctttgaaatacttcctacttcattctcaaatgttcgttgcttctttgatgatgtatctaccattttgtttctgtttataatcgtttcagatcgtctgatttattattggccttcggagtttttcataatcggatcatattttttgtttcggtacgtttttttgtcctccactttatttccacaaaatatatttgtaaggttactcaatcaagtacgtacctatattgtgctattgaaatttcgcatttctgtaaatcacttttgttgtatgaacaggattcattaagaaaggtttcttctgaaatatattttcaaattatgatgttgttcataaccttaacgaatttaaaaacgttttttgtacataatgttaatatttatttactcaaataaattttttgtactaaatcactccagcaaatgtcaacaattcaattgttccgaaatgcaattatttttcatcaaattgtgaattgttattgatatcgccaaagagattgaaatgaattttaataatcgagagtggataaatagtttattacaaagtgtatagaattgaaacgagtttgtttccatgtcatatctatttattaaacatgtacattaaactccataatgtaaatattaatcaacaactaatattaggaaatttatgctgatgaagatattgacaccttgtctttgagattattttctcacataactaactctttccttgaaatcgtgaaggtagaatattatcgtcaagaatccctagattgattgacctattgtaaggataattcaaatcagccatccttaataaaaactatctgataaaatttaaacagatatctgtatacaggatgacaaaatgatttgtaaactgatgtatttttgatgagatggttgttaaaattataaactaaatactgttttattcaaagaacgtaaactttcacggccagagaactttgtgaaagctattctccggattttctggccgtggtaggccaactcgggcttcgcgaccgttaccacatagcatttgataacgtctaccgcaatagtggacgaaacatcaggcataaaacctgcagaccacggctaaaaggccctaaaaatagtttttatactgtttaattgaccaatattaagaaataatgggcataataatgcccattacgaaataagttggcaaaagcaacttaaatttgttacgttccaaataactaacaccaaaaaaaaattttacaaagagtgtgaaaaaataatcctgattcttcaaactatcattaagtgcatgtaataagtgagacattccaatgtagtgatggactttttcttttgaatatattcaatgtgattgatattttgaaaatgttgacgaaaaaatggctgtataaagatgtaaatacattttattggtttcatgtaagttgctcagggattgtaaatgtaataacgaaataaatgttaa

SEQ ID NO: 210 - DNA, 1696 bp, Leptinotarsa decemlineata
  Annotation=Prov protein; Tribolium gene name from OrthoDB database=TC015801; Blast E-value Tribolium Gene vs. Leptinotarsa Unigene=1E-51
gaattaaaattttagtagtcgccattttaacacatcagttcgagtttacaacgtttgagtaattttttgctagtatttcattgatattattgtaagatgaattcgttaatgggttatggaagtgatgatgatccagatgactctcctgataccagacaagtggacacctactccagttcaagaacttatcggaaacctgggggaaactcccatgcagatgacactaactatgatgaagttcaaatgagccttagtgaggattctgattgtgaatcgaagcaccagcggaaatcgagtagggagaaggacagtattcgtcgttgcagtcccaaattcagagatgaagataatcatagaagagataggagagatgacagaagagatgataggaaagacaacggagacagacacagagacagggacaggagtgaagaaagaaccaggcataacagagacgacgaaaagcccaactatagagatgatagagaagaagatagagaaaagagtagcagagatgatgatagagcaagagatcgaggagacagattaagggaaagagatgataataaagtgaaagatcgaagagatgacagacgagcgaaatccagagagagatacagtagtagggatgatagatacagaaaagacagagataggaggcggagcaggtcaccaagagatggaagggatagagagaggcgacgtagtaggtcgcctcgtagaaatgaaaggtccagatcaagatcaagagatagaaactcgaacagaggtaaaggaggaggatttgccaggcgattcggcaggggatatagcagaactgatgatacagataacacagctggcgcttcagcgcgatcggaagaaaatccaactggaggagatgctacaaacaaagatagattttttgttcctggcattacaggtagatttagagaacaaatagaaaagcgtaaattattatggcagaagaaggaacctgaaaagcaagaaaccgttgtaaagccagctccaagctttggagttggaggatcaagaacaacaaaagtttgggaagcaactacttttgctcaagacactgatggtaaagtcgctaataaattcaagagactcatgggaataaaatctgcaactgatggcaacagtactgctactgaggttcttaagaaacaggaagaaatgtttacttcaatggaacaacagtatgaagtagctcgaactgccactcatacaatgagaggtgtaggtttagggtttggaagttatccccgataatttttttccagaatttgtttgatatttatggataaggaatattatatttgatgtttaaattggttattttgttgactaggcaattacagtttttttgtaaatcctacttttttcgagaatatattttttgatttaggtctaatttacaattcaggtgtatagaatgttttgttttgtttttgcaaagatacaattgaattctaccatcaaatggaagtcactttttgaaatctgatataatgtgttgtgtataatcaaaatatatggaaagaacacttctgtatcgataatctctggtcaacaggagttaatttaatgaaaataagtttacctcagctttcaaccttcattcgtggctgttaaagtgattgggaatcttacctgtagtttttggggcaaggtagatttgtgatgtaataaagta

SEQ ID NO: 211 - DNA, 2511 bp, Leptinotarsa decemlineata
  Annotation=Retinoid X receptor; Tribolium gene name from OrthoDB database=TC009140; Blast E-value Tribolium Gene vs. Leptinotarsa Unigene=0
aagttttttgtacaagttaaacatcgactgatgtaatatctataaaacaatcacacaaagttatgggatattttcaactaaagtaagggaatatccacatctaatcatctatcactgagcttacaacacgattattctcgaatcaacaactgcctgcagtttgttcgagtcaaatatctgatgacaagtatataagagtcatttcccaacctatttatctctcgttttcaaaaaatgatcaacatctattacttctaccctatcatcttccacctgaaaatctcaggataagcaacagatataattctacaagaaaatttgcgtgatgtgtgaaatttataagtgcacgaaagtctggatatcacaaacacaataaaaactcgtgtatattttcaggggataaaaaatcgcttgtcctgccagtccgtcacagccttattaatcagaaaacactttttatgaagtcgcaaacattcataattctatcttaccagtaactagttacatcttatacttattccttaaaaattttcgttcgcgtttctgaaaaagcaaaaagtcaccgtcggaaaattacaaatttcccaaattgtgactttgtcacaaattttcctgtagtgctatttgggagacagttagaacggctaccggcagtacgcttccaacatttctaaaaacaacttgttcattggaactagatcttgttgatgaacgtctgaccagaaccttctgacaatatagttcgcttgtcgcaatgcgggcaggcacagcaacagctgctggatctggttcatcactcctgtaggcctgagaatgcctatagcgtctgatagggcagttaagatggaatccctaaattttttcagcgaatggtattgttctattttcacatcagaattggtgagaactagggctttcaggaggtaatattcttctttcgatattgatagattatctaacctttcgacgacatggcaacatgtctgataaagttccagagtcccgcaatccctcgactgcttctcatccagtatgaaatctgtcgcaaactgcaaccttcctaatcccaccagaggcaaactcctgaacgccaaagtgagcgtaagaatttctgcccaagtgctctgcaatagccgcatctgatcgttcaaagacaaatccgtaaagcccggtatctgcttcgcccatccaattattcctactaattctcggtcatataggtcgctcagtattgaaagggtcctatgtttcgagttctccaaggctttgttgatgtctaagcaatcgggctcgcaaccgataagtgcctccaacatttttatgtcttctaaaagaagcaaaggcctctgtgcagacacaacttgtacttgatatggactatctggatttcgacgatacttttgtctaccccctctcacccgatctagtcgaaccccttctttgagcattcccgaacgcagacacttccgaaatctgcatgcttgacatgcttttctccttcttttgtttatttcacattctcctgaagctgggcatgtatattcaatattaccttgtattgtccgtttgaaaaatgctttacaagcttcacaagaagctacaccgtaatgaaaacctgaggcattatcaccacaaacgaggcagagtcttcgtggggaatcttcctcttttatttcaccttcgttggtatccattcctgagtcagtgtgaggttgtgtggttgaggagcaatactgtcgttccggactacttggagatcgtaaacttttttcatagctgctttcgtgaaaatcgatcttactgtctgccgatctaatgatggtttcattcaagaccgttgttgtcggcgagtacatgccgctgttcgatggtgagcaatcggcgaaagcttccatttcttttttgatgtgcgtgacacatcctgttgatacgtcgccagttactgagtccgtcatcattgatacctgtcaataacattctcactggtagaaccttcgccaatcaggaccaggcaaaaacagtctttgactccatcgaatcccgagcacataatttttaggctgactaaattaattgacttaagtcacggtggcgaaagtgcactaattcaaatggcgctaattttgatgaaatcgaacacgtattcactgggacaccagacaaaacttttcaaacaccctaaaacttttaaaacaccctaataaaaaaacatcgtcaactggtctgaaaatcaaaattaccgacggacttaggtttatataactatgcactgacagtgagctattctgctctctgtctctttctctctaataaaatcaaatgttaactatattgtctttcttttccacttgtacaagaaaagggtgctatataaaagtatgtcttttatctctaattttattgatgccgcatgtgtattctttcgtggtcccaatgaaataatgataacttgttgataaaatcgctaataaatattttatcaactattggaatggcaccagtttaacactc

SEQ ID NO: 212 - DNA, 2008 bp, Leptinotarsa decemlineata
  Annotation=Zgc:100980; Tribolium gene name from OrthoDB database=TC006359; Blast E-value Tribolium Gene vs. Leptinotarsa Unigene=4E-68
gtcagaatgggcaatgggtaccaactggcgagtgggtacattcatggaaaagtaaattacctctacagacaataatgcgcttgttgcaagttcttgtaccccaggttgagaaaatttgtatagataaaggactgaccgatgagagtgaaattctgaagtttctgcagcatggaactttagttggactattacctgtgccccatcctattcttataaggaaatatcaggcaaattcaggtaccacaacttggttccgaacatacatgtggggtgtgatctacttgaggaatgttgatccaccaatttggtatgatactgatgtaaaattatttgaaattcagcgtatttaaagagtaagacatagttttttgaagatctttactagtttcacagataaagtaagtttaaaaaattgaaatatctttatttattcagtgttaggaaaataatgaaaatgttgttttcatttcaatgtggttcccaaattgttgtacctgcatctgattaaaatcaacaattactgaatcagcaaaaaaaattgttctacaaaaactttaaaatcattataattttgtctagtctgttttcctttgatgataggaaggtggttgttttccggcgggcatttaccagaacctacagtgaaaagtagaactggaacttctcacatagaataaatctatcacaaacacttctctcgcacaccaggactgcaacactcatgaagagagaactcacgcagttgtgatgtgtgggggttgtgtttttgttgttgagcagaatgaaactcataaaaatcttgcaatattccatgaataatcaatcatgagtggcaattttcatcctgctgagatggtcaaatgttattaagatcgaagtaaaaccgttgaattctgctactcaatatacaatcaccaatctctgttgaaccttgctattgagtcaagggtgctctatattgagaaatttcttctaatcagggtttgaggacctttcagtttagacagaatatatctgggaacttcatttgtcaacaatcaaaacattactgagctttcagttttctaatttttattaagtcattccaatttctaaatgaaaatagaataataattaccagttttttatatctggtatattttatatatagtatgttctgtattgtgtaacattgtgatatagccgtacttaatgcattgagattttttcaagcttcattatgccctctgttttggtttcaaactacaatttctaacacaaaattgaataatttattaaaaacgctaaaaataatagttttcagttatgaaaccaaaacatataaatagcagtactatacttttttaataatatctgtagggtacgccaaaagtttgggaaatatccaatatttctgtgtgcaaaaccgtgtttctttcaaattcggtaagtattcccattaatgctttactctgaattgtcacctaacctagatttctaataataaaacacctactttttattgtgtatttaaaaaatacgctgtttcccatgaaaattttttttaactattcctctattgatcctatgaaacaaaattatttatatgagggatttcaagagaattaggaaatacttatggctgaaccagcagtaacaaaaaaaaagttttataattaattaatgttttgttcattactgtagagacataccaaatttgaatgaaatatgaaaacagatatatttgattgttctgggtccctttgtatatatagtaatataatttatatggtatgaatcatttgttaatggaaagtaatgtataccaaagacaatgtattcattttttctatagaaaatggtttcagaataaatttgaaaatctcaaaaatttccattttattaaaaatctaagtgtcttattcatacgaaatattttaattgagcatttattgtaatcataagactgtaatacatgctttactagaacaattatgtagttttgtaatatagttaccaagagttagtg

SEQ ID NO: 213 - DNA, 2575 bp, Leptinotarsa decemlineata
  Annotation=Nucleolar protein NOP5, putative; Tribolium gene name from OrthoDB database=TC002968; Blast E-value Tribolium Gene vs. Leptinotarsa Unigene=0
gttatgacctcatcagcccatataatttttctagaaatcctggtcaccacaatgttatgttgaaacaaaaaataaaagtttacacgttcattcaaatcacattgtcgataaaaatgaacatattgaaataatcgttttaagaatataactgtacacggtttgacggttcagaatggtacctgatataaatgaacattctaaagctcacacaattttttccagccacggcaaatatttatttctaggcaaatagtgtgttcaatttgagattttcaaacaggttttcaggcaatcaaaactaatatcatagttactgtataatcaatttgatataacaaaatattaacaaatttcagctataatcctattcttaaaatctaaataaaattgtcgagcacttcaacacattttatagaaaaaaattttctatcaacatttaaaagtcatatttatgaaactatctttataaaatgtttaccgtaaagtatgaaggaaaaccatcaagagacacaaaaatatattttaatgttccccttgaaaaacacattatcaaatggtggaaattatatttttgtgaaatctgatttattccatttcgttatctgtgtgcttcttcttcttctttttctttttttctctgatccaagaccttctgcttgctcttttgccggcgtttcctcctgggattcattcatttcttgtttaaccttcttctttttcttaggagtctcaagtgtttcttcctctacttgttctacatcctcaatttcctgtttcatttttttcttcttcttcttgggaggttcttcagattcttccaattttacctctgatgtaccttgttcttcatcttctaccttctcagccttcttcttcttctttttctttttgatggatccttcttctactatgctgtcattgatttcgtcattgatttcctccttgacctcttctggttccctcttccgtttaccaacagaagggagtgtggaatcagcggcatcgggatattgtttgatttcactgataccatgatacttctcgaacttggctttcgctttacctgtgccactgatccttcggatattccttcttctagtatcctcaacctagcttccaatttggctttatgttccacccctaaagagcaaatactgtcctctcctaaggcatcaactctagtagctagagcggcctttgctgccaacattctagacatttttcccttgtttcttgtgctactctgacccaccagttgagcatgatagatgagaccatacttgggggtatcctttttcgtcttcaacgctctaaagagagctttttccgcaccgagtatttgaatggtagaagcaggttgctttgctaaatttatcaaagatccagcatgagaaatcagccttgcacctaccagctcaccaacaagaacggttagatttggagccatggcaatcattctagctttcaagtagtcgaacaactgtgttcggtagttcatgatatcgatcacttggtcacacaaattttggatatttatgatatcttcttcggaaatttcggttcccatagaaatctcagcggcctcttttactttctcctctatatcctccggaagaatatcagacaagtctgacgttgatgtgttttctctggtacctatgatcttgacagtttttgcgaatacaaggttatctgtaataatctttcctagttcaggaaaatgccatccgtaccactcccggcatctcataatgtaattgtttatttctttatctaaatcatccaacaaagacacagcctgcacaatcattgtgtcaactttatcgggtgagaattttaacttgtatctagacaaagagtgagctaaacccaaagccattgctgtcatctccttctttggcaagcctgatataaggctgtcaagctgagaacggatgcatctcatcaattcctgaaccgcattattcgagagacattgcacactgaatttttctttaattgctgatcccagttttgcatctgctacaaggagttgctcttgtaagtctgtatctacatgtttcttgagtactttcttcaagctctttgaaatttttccttctactgctgctgtagttgctgctaatgcttctgttgtatcaataaatttttcaaaatgcttgagtttgacaatatttcctgccgattcgggactttcaaatgccttatataagttgtcggattctttgagtctcttctcatccaaaagcttgaatatcgcatatccagctggagtttcgaacagaaccaacatttttcgcttaaaagagcctagctctcactaacttatatttataaatgaaattttatttcaaaaacataaccacaacaccaaacacctcgaaacgttggacttatgtctcccctttgcacgctgcacgagaacttcgactcttcacagcgttgccatgttgccacaagatatttcttcttctttcatatgtatgttcgttgtttctttagtcaggccatttgaccagcgcgcctctcagagtattattctgcggtgcgcctcctaatacttaataaaatagtc

SEQ ID NO: 214 - DNA, 1651 bp, Leptinotarsa decemlineata
  Annotation=Shifted; Tribolium gene name from OrthoDB database= TC001979; Blast E-value Tribolium Gene vs. Leptinotarsa Unigene= 0
tttcaaagatatgaattgatcaagttacattgcttttttcccaaactgaggctttaattgggttttggtactgctttgtaataatgtaacaaaatctgcaaaatgcaataattgcctacttctttcgaatgctatgaaatctctgaagaggaatgaagcttaaaatactaatgcatgtataccaggaaccttgtgatgtggaaattcatattggtggttttgataccaattttgacatctgttatttctcgagatgacaagaataatagtgacttgtcactatggatagatgagaaacaagtcaaaattttcagtggatcacctatgaagatatttgccatatctaatggaaatgttttaccctatatactggacccaaattttgaaaagtatcttccagtgatcccgtccgaagtcagttatgtgaatttcacgtggaaatctgagggcaaaagatattattataattttgatagattacagtcattcgatgaaagtatacttgaagcccccgttatttccatcaaaacgaaaggacgagtacctaggcaacgcaaagaatttagcatttttttaccttgtcttggtaatagctccggtatagcaaaatttggaataggactgcttattgaaaatagaaaaggaaaaccactttacggaaccccattaaggctgaagctgaagaaagaatgtgcacagaggagcccagatccagagtgtgataaaaaatgtgcaaatcaaggttggtgcaatcatgaaaaaatttgtcagtgtcctgaaggttacatgggacagtattgccgaacagctttatgctatccacgatgcatgaacggtggtaattgtacatctcctggaatatgtagctgtcctccaggatttcaaggcggccattgtgtaggaggaatatgtagccaaaaatgcctgaacggaggtaaatgtatccagaaagacacttgcgagtgttcaaagggttactatggtccgagatgtgaatattcgagatgcatcattccttgcttgaacggtggaaaatgtaaagcggtgaataaatgccgttgtccgagaggtttcagaggagatcactgcgaaattggaagagcaaaaccacacagaagcaactgccatctaccttgtaaacatggtacttgtgttggcaatgcttgttcttgtgatcaaggatggtatggaagactgtgtcatcacagaattatgtagagagcttacaagagcctggctatttgtacttatgtaacatgttctgtgaatatattcttgtgcctttttttctccgcaatagagaaatttgtgatctttttgaaaaaatatattgtggataatattattttgtactagatctggtaaatactgatatgaagttgggtaacagggcccatttatatttcagtttatgttttgttaaaattatcaacagcagtgaaagtccaaagcatttattgttagtattttgtgccaaaatattttgtataaatttaagaaattttatatatatatttaatgatgatcatatttagttgtgtgatattacaaattaacatatttttttaactaaatgaacaacaaagtcttcgttttctactctattggaggcattgtcaacacttttcgtttttttggaaataaaaatttt

SEQ ID NO: 215 - DNA, 3049 bp, Leptinotarsa decemlineata
  Annotation=Integrator complex subunit 8; Tribolium gene name from OrthoDB database=TC009538; Blast E-value Tribolium Gene vs. Leptinotarsa Unigene=0
gattagggttaggacctatgactgaaactgacgtttggtatttatgtaggatgcgaaagacttcagacatataaataatgacatgaaatattcaacacagtatcagtaataccttttattcaacatcgaaatggaagtggatttattcagacctggcactgttcctatatcatcagaaacaatattatggttcgagtttttgttggatcaagatttgttattgagacatttagaaaaacccactgcagatccaccaccttccgaattgataactaaattttatgatgttatatctgaaactctgagaatcaaccctgataatgaaaatggagaaataattaatgttgataccaatgtagggaagtctaagtctccagcgaggaccgtagctttgaaaattttgtctctgaaagttggagcttatctgaaatggaatctagtccaaataagaaagttgccgttcaaaactcagatcaatctcttcaagatctaatgtacttcaccaatgacaagaagactgtagagatacccaatgttgaggatgaagatgttaaaacagcttcaccaccttacttatttgctttattgttgtttcaccgttggctgctaaacacttcaatgcacaggataacatccaattggcaaattagatatggaatcaacgacatttcgcctgctgatgaatccatcatttgttgtccggaaaacatcaacaaaacggtcaactttctcacggattccctagactgggacatcgttccgagtttattgacatttgactgtttcaaactccccacagagaacaatgattgcatagaattcgactggtccaaaagtcaggaactgtctaaaaacgagttcaatgcccagatcaactacgatcttggcgtgttctttttctatcgagaacagtacgatctggcaaaaaagcatttctccaagtgtctggaactgttcagtgatataccagaaatcaatggattctatgaccttgataagaatatgcttgatgtgtacatcaaagcttgccacgggtctgccgatatacagcaagggagtcttctggaacagctgaattcctccattgtgaaccagtatatgggtattacaaacattcttcaacaagacaatgttcggagagagatcccattaatgcacaggctgaatctggaactcaatatacagggggctctgtctagtggagctttcacagtggccagggatttgcttcaaaaaattaaaatcctgaacatcattagatgtattttggataggaagcctttctatcaatattccataacgtcttggcataatgcagatttatttgtttgggcgattcagtcttcgtggaaatcatttcctcagtcagaccgagaaattatcaaaaaatatttgatggaactttttttgaatgacaccattccaggcctgttagaaaaaatccaatcaaacgatgaactggccgcaatgctggataaatccgacttgaactatatcaagaatgcggaagacaaatttgatatacctgagagtttactcagaactgaaacagctcctgatcttggtagaagaagaaaaccgcagctggagatgagacaactgcagaaacagctgatttctgcgaatgaccataacgaaattaggtctcttctagtgaaactggcttcgatcaatcttggcgctagcgtttggaatatcaaccctcaatgggaactgcccattcctctacagagtgttctgaagtcactgcccagaggtttcctccaagattttgggtacgtcatcttggccaaatcgaaggagcaacttttgaataaaaatttcaacttgtctctggagtttttgatcattttggaaaaggagttacagactgtcaacatgaatgtgacgaaactattcaaactggtcagttgggaaattctgctcgttcaaatcactcaacttttggaccagtggccgaaacacactgttgatagaaacgccctggctgacgcctgcgaggtttgtctgcagactaccgactctgtgattcccagaaccgaagttgtcgaacagtgcgccatttgcctactaaatttggctcgttgggacttcctgatcaacctcgagaagagatggaccacttttgagataacttccgccatcgcgcttgcttgccaagaaattttgaagcaaaaaggaagtaagaagttgtcgaagaatctctgggatatagtgttgccagttttcctttcgaatccccagtcgaaacgaaacacttcaagttacgacatgtccaatttgaagagcaatttgctgtcagtgttcttcaaattgaaggattcgtggtgtttgtcagtggtgatttctctccttaccaaaatgttcaacgtcctcaaggacgaatgcagtctagagctgcaggtcgattacaccaacctttggcctgcagttgtgagcaacgccaattcatacagctcagagtctgtgtgtgagttgttgtcagaaatagtgacgcgggctctcaaagattatcccacgaatgtaccttggcttcgactcatgggggacatcaatttcgcgaacggacactacagggtgtccctcagcttctacctcaagtctctgctgatatcacacgactacttcaacatccccatccacaacgacgaccacgtcttcaggaggatgataaaatgctgcacgacgctcgggtgtcacacacaagctgctgtcctttgccagtttctcgaagaaacagactacctgttggcgtttcgtatactggccgatcagaaaaccagcagtgacgctgtcgacgcctactaccactgcttctgggacccgagtatcttggagtatctcatccacacgcaccacaagaagggggaggtatcagagacggaagagcgccattcaggtaattggattattggagctgaattcaagtaacaatgaggagattcagagagaggccagcaatttgagaaagagcacctttttgcgagcgctgtgtaaacagtatgtgttttaagttgtggactgaataaaatagttattttttattgaa

SEQ ID NO: 216 - DNA, 1853 bp, Leptinotarsa decemlineata
  Annotation=Histone acetyltransferase type b catalytic subunit; Tribolium gene name from OrthoDB database=TC002077; Blast E- value Tribolium Gene vs. Leptinotarsa Unigene=4E-117
tcacaaagtggataactttaaaactagtcaattttattttaagaaatacatgactgaaaaaaaactaaatgaacatagacacttaggaaaaatacaaaacaagttaattttaaataaatatacaaacaccaattgaaaactattttcagtttttttctgactacaaaatgattgcaaaaatttaaaatgacagattttgttttattggaagtttcctgaaagtcttaccatctttcttcaaaataatgctaaaaaaattactgactattagtatattataatatttcttgaaaacagcgaagaaacctaattatttcaaatacagacttttggcaactggacttgctgagagagaaaaatacccacaactattcaatggttattttcaattttttttctaaaatttttcattgattgttcaatatcctcaatatattttttatagttagcttctatcactgcattcttttctgtgacatctagattagtagtcgcacctaaaatattttgtctttttttactacccctagtttccttttcattttcagaacggatgcgttcctttatacaggccaaaaaacttgtgtaattatctacattttgactagcctcataagccctcaaaatgtcatatattctcaaacattgtttcctacatattttatttgtttttataatattgaagatctttttcaaattgttatttgtcaaacttataccagtttctttcaatttgttataaattatggaacagtcatctacatctcgtattctctgaaacgttagagttggttcctctactgtgatgtccacaacgtcagcaattccttgaatatgtttgaacactgtttggtaaagactagtcccaatccctctcttctgatgggaaggaagtacgaagaactgacttattctggctctaattttatttggatacgctaaaaatttataaacggtgcagtacccaactggagtgatgtagggctttcctgtttctggatgaaatacttcttcaaatgcataaaaaatcatccacctttcatcagtcagatctatgaaattggctccatcaatgaaccaagtaataaaagtctcaaacctactatggaattgttgaaatttttcatcttttgtgtcgcaaagtgtaatcttgtatttagcgtactcttcctgactagggatgatttcgttctttttagtgtctttaaattcactcaaaaccgttccatagatggtatcgtgtatttcattttctatcatttttaaaaattcatttttttcagttgtgtagttttctggtagatactgatccaaggatttcatgatgtcatcaggttggtttaaacctcctttaatttctcctgatgcttgaagatccacgtagcaccgtgctgaattgtggagataatataggtttattgataatgatcgatatccaaaaatgctttcactgtcaccaaaaatttgatgagccattataggtttgaattctggatatttatttttttctacattcattttgtcatacactactctgaatgttacaacagaaagggcatctttcttgaaacacgacatttcttcttcctcttcgtcagatttgctaccagtacagctactactggccatctttttatttttttttgtaaaaacgaatataaaatccaattagataacctgatctaatttttttttatgaatcctaataaatatttgatattcaggattctggaatagataacatgcaatcactatattctgtacaaactttagtttacaacttttctgaagccagagatctttttccttttggcgggttacttcttattttcttcttctccttttcgtaaagc

SEQ ID NO: 217 - DNA, 2781 bp, Leptinotarsa decemlineata
  Annotation=CG4662, isoform C; Tribolium gene name from OrthoDB database=TC001761; Blast E-value Tribolium Gene vs. Leptinotarsa Unigene=0
gttgacattatgacacatcatttcaaacaatgtgattcatatatcacattacatttatttcattttagagtttaagtacctacaattccagaacaatggcttcaaaattgttcagaaattacggacttaaactgaacaaaacagccttgagacagtttagcaatagcaaaaattcagttagaaatggcaaactctttcctgtctactgtgctttaggaggatcagtaactataatgattgctgtttataaaagtagatactttcccaatgtctttgcagcccaaacaagaactgaagaagatgttaaagtagttaaacttacatcaagagaaaaaagattcattcgatttgcatccgttgaatatgatggtcagctatatatgactccccaagattttttagaatctgtggtagaagcagaacccagacctagaatgaagcggaaaatattgagccagaaagagttggagaaaatcaaagatgctaccccgccactcaatcaaggttcaccaaggttgttcagaagtttgagagaaaaaggaattatttcttatacagaatatctgtttcttctttcaatattaacaaagcctcaatcagggttcagaatcgccttcaacatgtttgacacagatggtaaccaacgagtagacaaaaacgagttcttagtgatggaaaaaatattcagccatgcctggaaaggaaagagaggcatgaacaatgaagaaacagaacagatgattcccattcaagagcaatatgtagatgatgaacagggacttcaaaggaggcacattgttgataccactttaatcgttcacttctttgggccaaaaggaaacactgatttgaattttgagagcttcaaaaagtttatgctgcatttacaaacagaagtactggaactggagtttaatgaattttccaaagggcttatgacaatttctgaagttgactttgcaaaaatattgctaagatacacgtatttggatacagatgagtatgacatgtatttggatagattgctggacaggataaaggacacgaagggaattacttttgaggagtttcatgtattttgccagtttttgaataacttggaagattttactatagccatgagaatgtatactcttgcagatcatccaatatctaaagatgaatttcacagagctgtaaaaatatgtactggcacaaatttgagtcagcatctggtccatactgttttcgctatatttgacgatgacggtgatggattattgagttatcgagaatttattgccataatgaaagatcgcttgcacagaggattcaagtcctatgctagaaacgaaggatgggaagcatttaagacttgtatcaaacaagaaatgaaaacccccgcttaggcttttgaatcttcatttgaaattgccacttggtaaaggattttttgagtcctaccaagtatcttagtatttatgtttgcaaataactttaatcagaacttgctgtctttgaaatttgcaaatattatctgaaatctagaaagaattactttgatgaagattttgatttttaattatccagaatgaggaaaaatacggactgaattattgcagactgtacttaatttcttttaagagaaaaaaaattcagcatcaaattgaaaatctcttattgaaaagttgaaaaattttaaggtaaaatctcagtttattatttgtctctctatgtgatttgatgatatatgaatttggttgtgacattatatatttaaaattgtatcatatattaatttaaaacttataatacctgttgaaccctttggaatagttcaaatatcaccagtacaaaaatctattatttcaatacttatctgattgctgtgattcaacagaagggttcatagttaccataatattgctgacacttgaatagtattgtgttatgaattggaactagtcaatgttcagaatgccataatttatcattaagttatatatgtatagtattctagtttatggattgtttattaccttgaactagtcatgtgtttagtaattatttttgagtttttttcggagtaagcttccaagtctttattggtcagtaaaaaagtgcataaaattcgatattatatcctgggaataaacacccgtagcaatattaggtttgttttggttttgagttcggatagttcaatcatgtgcagtgattgaaacttgttttggttcatttagaacagatctgttattgtgcccatagtgttttgttttttcagaagggtagttatcagttcagacattagagtaggtactgattagaatctccagttcgctgatgtgcattattgaaaattttcatttatattgtgtacaaatgtgcaaattctttgggtacataacctcagtcctgatccttattgtatctacaatatcaaaattttatggttccaaatgaaacaactaataaaaaatgaactacaacggaatcatggattttttttatgttttggttttaaattacagaactgttctgtagctggtgtctgctgcgcatagattcactacaatttaaaacaattctctaacagttcgaaatactgaaccgaaacaaacctatttttataaaagtacatatagttttgaaataggtactagtcatttctgggttcatcagttaaagaattctattttgttattacattattattattattattattattatggaatgttataaagctcaatatgttttttgaaccaaagatttgacattaataaaggttgatttggccgt

SEQ ID NO: 218 - DNA, 3761 bp, Leptinotarsa decemlineata
  Annotation=Myb-binding protein 1A; Tribolium gene name from OrthoDB database=TC015701; Blast E-value Tribolium Gene vs. Leptinotarsa Unigene=0
atctttatctagcttctttttctttttgttgattttgtttgtactgcccattgggtaaatcatctgcttctttgtctacttcctttttttagttattacttgtcttttcactactgtcactttcttcctctataccattttccggatttttactggattctaaaacaacatccgaaggtatagcataggtgtctactgattccatatctatttctgccccagctttgaagtctacccctccgaatccttcagacaaacttttcagcctcaattccttggcctctttcttcaatctcagtttttctttatttttagactttcttttcttcttttcaacatttttctcttcatcattatcatcggcatcacttgtgacaacttttgccgaactgatagatctaggcttcatcttcacaacattagacacacctaaacgatggcaaagcctgttgaaacaagcttttgaatccttggagagagttaccgtgcttctatattcccttacattttctgcaatttcttgccaccgaatattatcaacattcaaacaagtggattttattgtagctaataaatcgaacaagttacaaacgaatttctcttttgtattctctgcttcggcgttctcggagagctttctaaacaagtttaaaacattttcagaaaacgttgaatgatcttccgacagaatttctattactttatctgaattagaactcagatatctttgatttgtataaaataatttcagtagttcgaacacttgatttttcttgaagggcttgatattcttatcaaaaatatactgtaaaagtaaagacaccagcccaagggaaccatcccaggactgccgaagaatatttttgaagagtatcagtggagtgaaacaatctctttgatgcatgtatatttccaattcttttgttatcgtttcctgtatggaagacttcaatcgtttcttaatcttcttaggggtaccttctgaagaaagtaaaatatttgaacaacgaatgataaaaaggcaacaatctgctatctgtgaacccatatcttgaacaatccaagcagttttactgcccttgtctaacaaacttttcagtaggtcatgcagaacagtttcatttaccccgtcggtatcactgaactttttcaaatttgtcagtttcttcaagcatgatttcaaccttatcattagagctttctgatgttcatctcttatgcagaattctacagattgcaaaagaggcagcattatttcaagtgaaatgagcatggagggagtagactctacataaatatcaaccaagtctaatacccttattctgaagtgagttaaagtttcctcatctttggtttgcttcttacgtctaccgtggttgggtttgaactgcctgaaagcatctgctaaagctttgtcaagcttttcaccttcagtttcgctcatttgatcaatgtcaatgctttcttcatcagatttgtaaccattacttatcagcaccttatgaagagccatgcgcagtttatcattgacagtttcatcattagcatcttcatcgtcgtcgtcgtcatcatcatcatcatcgtcttcttcagaatgttcttcctttgtttcattttcagagtcatcatcttcttcactgctactttcctcagtgccttttgacaatggattatcttcgttcttcggatccatgaccgaaagtagttggtgaattgttgacggcgtcatatattgacacaaatgagggaaaactgtcttgattatgcttcttaataaatgagagttgtgagaaagcagattcaaaatcaaatcaataaccacttctatccacaacagatcactgttatcattagaatgatcttcaactgtatcgtcaaagttttgggagatatctctattcttttttgttttttggtagcaaatgaatagctcgttgagggaatctgtggctaatttaggttcattgaataactgaagacccatatgaagaaatagagtaagaaacacagatttaaggcccacttttttcttcttttggagtttattgaatatttttgttatgatttgaaatgtttctttccaaatattgtgctgttcttctgtgagagggtttctcaaaatagttcctaggtcttctgtacttagtttggaatctaaatgttggacaagttggatcagaatggcatgtaaatcttccagttttgtcagcttcaaatctaaggaaccgaagaatgctgttttcaaggaggctgctaattcagaacctatatgtgttccattctcgtttctcaacaaccctaaattcatgagataagagagttgttccactttccaatcattttcttcttttacgacagtatgattcaaaagtttgatcaataaatgagctgcatacagtttatcattatttagccaatcttcaccatgtccatattgactgtcaatgatttcagtaccatcaattactcctcgatagagttctgctaatttttttacccctttattattcaaattgagggtgacaagttgaatgagcttacttttggtgattttttcaaatataaatgttccaggggagagaaggagcttcctcagaacagtaatttttgttttagatttgacattatcacattttaatgaagcgagcaactggtcaaagaagttttgcattatttgttgaaattcagggtcctgatttttacctctgagagtcttataaaagttcagagtttgctgtacgaaatttttggtcaggaaaacaggtatgactgaggggtttttcaacttttgcaataccaacgtaaaaatgtgggctacaagcagctgtttatttctattaggataatctaagtgcttatcaagttcttccacgaaatcagacagtagaacagagtcagctatttcttctgctacaagttcataaacaaaatgctgcatcgatgccaatcttagtatagacatcaacactaaacacagatttccaatattctctgggcaaataatttcatgggtaccaatgacttttttcaaaaacatttcatttatgatattcggacacttatttttgatactgtaaagcatatagagtgtgtccagattttgttcagaccagggcttggcaatttcattttctagaatcggcagtatcttctgaaagcctctttcatcaaccttgtctagtgctgctattgcaaattgataagcaagtatttttagatacgatcgttccctagaggatttcattaaacattcaaatactttgaatttgtcttggaacgaacttctttcccaaagatttgatctgataatggccccacatgccaatatttgtcctgaagaaatatccgcattttctgatttactattactacccgacttatttaagtgtttcagaatgtgttcaaacaaaacatccactgttatttcatttttgatattcaaaagtgccactaatgccgtataaaaccccgtccttgcattactagtagaggcccctaatcctctgattattcttccacatgcatatttcacttcatcgtcttttacagaatccccatctccggacaaatgtctgagaagatttatgattcctttgaaacgcactgcctcttgttgatgcgttaaataagtaaaattatcaataaccgtcctatttaacgcctttttcactttttcaaggctttcaccgtttacctcgaccatttttacctcaatgtctaaaaattttaacaaaacataaccaataacctctctctttctc

SEQ ID NO: 219 - DNA, 1306 bp, Leptinotarsa decemlineata
  Annotation=WW domain binding protein 4; Tribolium gene name from OrthoDB database=TC011685; Blast E-value Tribolium Gene vs. Leptinotarsa Unigene=9E-64
gtgacagttgcgagttgtgacgtgatttgttgttttattttttatatggctcacatataaacttcatctgagactttattcaatttccattccatagtgtttagtgtctgtacatttaaatcaaagaagcacaagttacgacttacgagcgatttgtattcatcgttctactttcaaacatggcagattactggaaatcccaagatagaaaatattgtgatttttgcaagtgttggattgctgataacaagcctagcgtggaatttcacgaaaagggcagaagacatcaagaaaatgtcaagaaacgtcttaggaacattaccaagtccagtgccaagacacagagagaatctgaaaatgtggacaaagctatcaagaaaatggaagcggcggccttggcagcgtatcgaaaagactttgaaagcaattctgtcaccgatttgacttcaattgccataaaagaaaaaatgaaaaatgaaagcttaactttgagcgaagacagtaaaacagtttggcatgaagctaaatctaaggagggaaacacgtattattggaatactttgacaaatgagtccgtttgggaaccgccaaaagaaggttatctaagtattaaagaacaacgagaacaaaaagattcggaaacaacaaaacagttgaaagaagtagataagtatagaagaacagaggcgttgcagaggatgcaagttcaaaagatggaggaagatgaagagagggcaagattagctcgagaaaaaatgaaggaaaggagagtggtagatgatattccagaacctgtctacggaccaatcattgatcccggtaaaaatgatccttatggaaaatggcaaacagttaaggaagaaaaggtggttgatttacaacttcccgtactgcaagagcagtttgagtgtccagtagtttatgaacctgaaccagtcaaaaaggaatttaaagaaagaacagtagaaagtctagatacatgtgaacaatcttctacatttaagaaaagaaaaattatttcaggagcacagagaaatactagaaaaagattggaggaagattgaatctataaatttgtattaaaaacacatttcccttaccacaacagaatactgactctcaacacgctattctataaccaagttagcatcatcaggagttgattagaattaaagtggaccatatttgttctgctgcgggaaaatgtgtttgataggttcattttgatgaggagactcaaattctacccaatcaataatatttgtttttgggttagaatggccgaagtgaagactgtttgcaaaat

SEQ ID NO: 220 - DNA, 1851 bp, Leptinotarsa decemlineata
  Annotation=Abrupt protein, putative; Tribolium gene name from OrthoDB database=TC009535; Blast E-value Tribolium Gene vs. Leptinotarsa Unigene=2E-81
tttcctcacttgaatgtatactcttgaaaagtgttaaatatacacatttcatataaaatctagagcatccactctgtcatcctcactttgttgacggataattattccatgatgaaattaaatgaaaattattccaagatattatatactaatttgtggaaaagtggtaacaatatagtatcaaccaaaaattaaatatttccaattgtatttacagatatttggatatgcttttctgactagtcgaaagtaccatacctttaccaagtgtattaaatgtttgccataaagtgtccatatttttcattaaaccttttaggtagcattactgaactttttctgggcaagtattcaaagtaaaacaaactattatcacagatcaaatatatgttgccatgaaggaccctgaataatctaaaatatgtttgtgaacgtgaacgtttatcaatagtgagtcaatacctggatattataaaaaagccttgggtcagaaaagcatatctcaatacatttgagattgattatagcaatataaaacgttaacactgaaaaataaacccctatttactacactttacaaaaactataaaacaataagatataaaaacctttacaaaaaatcatatgcgtcaagagtgactcttatatagaaatatattctttacagtccttaaagctctcattagagtcaattacaaataaatttcggattaaatatttgaaaaatgcacccatgtggttatagtttatcaaaaaaaaagaaaagttaacaattcagttttgcattcaacacttctgcaacaaacctcgaggtagttgccctaccacaattaaaatgagtaaaaaaatattatgaaatctctcttcaaaagtgcagatcatttttcactttcgctgacatttccaaaatcatttattttgcaatttaataactcacagagtattgttggtagaataaaaaagaattgaatacaaataccagaaatcttgagtgcataaattctaaaacgaaaatttcaatacacaaaaaaggacagaacaatgtagatgtattactcagggttaaccgaagactttaaatattcagtaacttttcaagtggttctttagttatatcaatatcaattattaaaaattccaattacaataaaataaatatgatgagatatataggagatttgctgtttaacatatttctcaaatagtaattatttacatctgaacacctgaactaatctgatgtttggcccagacctagtagctttataatacacctacaaaaatgttcataaaaacccgttacgtctaccatgatctcatagatcacacagttctattctctcttaatggcctgtggtgcttccgctagtcctttgactttcagtctgtctgctgtcttcaaaaatgccggtagctgttcttgacttacatttacttcgcctgcatacataaattccaaaatagcttgaaggtgactataggctacatctttcagtattattatggggtgtttcgaagggttttcctctaataaacttttgaagtaaggactacaagctgataggaccattttgtgagctttacatgtttggccctcacaagctaaagttacatctgtgaagcttttctcatccctcaggtgtcgaaaagacgtaaccatattgctttgaaaatcgttccatttcaagaagaattgttgctgatcagccattttatacaatatatttcaatctatatctgcagttcttgaagtatgtaacaatctggattatggatgttttgattttcacaatttataagatcatttgcacaatcttgggaaacgtcaaataataaaattgaggaaatgcc

SEQ ID NO: 221 - DNA, 1257 bp, Leptinotarsa decemlineata
  Annotation=Glutamate--cysteine ligase regulatory subunit; Tribolium gene name from OrthoDB database=TC008990; Blast E- value Tribolium Gene vs. Leptinotarsa Unigene=5E-72
ctgacactagccaaacaaccaaacaggaatttgaatcatttttgttgaataattttgtagcaattggcagcaagttgagattattcatatcatactaaatcagaagtatgctaacattatacttgtaattacgtttaatattttaggtaaaaattaggcggggtcgaatcacgtgttttagttacaatatttctaattaactatttttgaatcatggtgatggagaagtacaatttggaaaatctcgatgaattcattatcaatactgggaatattttatcaattaatgatattacaaaaaaacccaaccaaaatccatcagaagagttggtggatgctgttaactgcactatcaaggaatttcaaacaagtgatacttctcaaccacaatcagatcatttgctgattgttaacagacaaaatgacaatctcaaaataagtgaacatgaactttctgacctgaaaattggattcaaagtatttttgaataatgacaatcaggaatcatttactgaagctatccagaaagcacttatgattttgaatgtgaactcaattgatgatttgatcatatcgttcaaacataaacagtcagaagataaaaaagatgacttaagccaaatacaaacagtatggaaaatcctggaaagttttgtatctgaagaaaaaataaaacagattgggattgccgatattgaagaaaataccttcagagctcttcatgaatgggctcaagtgaaacccacgatcatacaaataaatcttgcaagttgttgtgtggtcccaccaacactgcaaactttctgcaaagaaaacaatattaaactattaacacacagcgatccaagtgatattcttccaaagtcttcggtggagggcatatttggaaaaccactggttctgaaatgggccttgaggtatttgattcatgtgaaatgcagaggagtattaactacaaagggttatttattgaatttcatgaaaggataaaacattaggataagtttgatgtgtaatattttatgttattttattctggatttactatatttatacatatgcacttgccattccattttttaaaagaaaatcagatttttgttaagagaaagaaacattttgaagaatggtgcaataaacatattttgatactgtattcgatataggaaccttggttgtgatatgaattatagttaactgacaaaaagttaataaaattattttattgagtgaaaattaaaaaaaaaaaaaaaaaaa

SEQ ID NO: 222 - DNA, 3067 bp, Leptinotarsa decemlineata
  Annotation=E74; Tribolium gene name from OrthoDB database= TC004816; Blast E-value Tribolium Gene vs. Leptinotarsa Unigene= 2E-84
gtatattagcgaacttcaatacgcgcgagagtgtactattttgcacgtaacagtgaccgatgttgaccgtcgattgtttcctgcaatgattctgatcaaccccagcaagatgtcgatcatagccgacttgcccaacatcaaatcgatggtatccccgaggatcaaggaagagtgctgcgaggactatgttagtactagtgttgatgaggatgctccgctcgacctgaggattaactgcagcaggatgagtcctgctagggattccggtaccgaaagtgatgatacggaagagaagatgatggtggacggaggtgattacaagcccttcaagaagagtctgattaagagatttgataaagagcaaaacaactacaaccaacttcaccagttactttcaagacaaaggaccgatctgcaacatcccagcttatgcgattatggacgaagaaaatccgtttacccccctacaactggttccttgcctcctagcccagccgattcaggcgtgtcggacgtagacagttcctcaagtggccacacatcggacgacctcaaggccagctgcaaccaaacatccattcaccagtaggcaatttattccccagacatcctctctcctggaccacgcaccatggacagaggcctcctaaccacatgtcccaacagttttaccaaccttttccgaccaatctggatccctacaacggataccttctccagcaacaccaagtccagcagtcccatcacatgcatcaccacaaccaatcaccattcacgacaccgtcgcctccctctcccccgatcaggcactccatccccacctcagtcatccaagcagctaccagcagtatatacgacgatccctacatgctgggtttctccccgagaaagctgaagaaagttaaaaaacaaaagcttggagaacccggaacggtgaaaaggaaaagcagggagggatcgacgacgtatctctgggagtttctgctgaagctgctccaggacagggaatactgcccgaggtatatcaagtggaccaacagggagaagggagtcttcaagctggtagattcgaaagccgtgtcgaggttgtggggaatgcacaagaacaaacccgacatgaactacgagaccatggggagagctctgagatattactaccagaggggaatcctggcaaaagtagacgggcagaggttggtgtaccaattcgttgaggttcctaaggacatagtggaaatagattgtacaggagcagcgtgaagtggtcgccaataaacttcccagccggtttgagagcctgctgtctcgaaagtacaacaaaacacaaattatttatttagatgaaatcgtctatcagattgtatatattagctatgactcaaaaacaaagacgtcaacaacgaattatccacttagaaagatctcatagtgatggtagcgagactcttgaggtgacctgtaaggatacaacgaggttgtgattggatagaagagatttccgttaaggttgtggtgaaattttccaactatgtaatccccccactatttcatacgttgcatagcatttaatcttaatcagaccaaaaacttgagcatttgaatgaagatcgtccgcaggactcgcgacagtcctttggacgcgttactatatttacatttgaaatgactgttcagtcacatgttcaatgttgcatttaaagtgcttttaatatttacatgttgtacaaaaataacagatgatttgtttgatcaagtcttattactggagtttaaaaaagttgacctgtaaataaaaagtttataagtgaatcaacggaatatctatctgttgtttgtttagtatggaatagtgaaaaattgttatataatagatttttatgaatatacctaaattttaaataaaaaatatcaattataatagtaataaaacgtcggatatgagtgaaatgtgataagaaaaggacaaggtattttgagaaagtctttttttctaaattttgttaccgatttttgatgaaatggaaggtgctttaaaaatggataagaaaagactgcgaggtgcctagcgattgacaagagaacaattgaatgtcaatgaatagctctctttaattgtataactttacagagtggcaaatagttttggtttctgatctcagtatgtacacaggaatattaaaaaaataaacgtgagtttgataaaattgattgcctttgataccttttttcgggaaggctctagataatttttcaaaaacactcaaaaaaatgtacatataaaaagtttttcgtacttacgttgagagaaatttgggtcatttagaactttttcaaattgtaatttattataagtgtacattctgtatagtatttattctaataatttcgaaatatcacatttaagtttttttttgtaaattttttgtaactttctgtgatttttgtaattttagtggattctaaattctgttttatataattaacctatgtacctaaagaataatgtgtcttgaactcttaattaactcagcgcaaatcaggacaaaacatagaatttaaataatataacccaggatttcttccagtgaaaatttatacctattacctaagaattgtgtagaatcaaatagatgtattcgtgtaagttgtgcacaacaaacaaaaaaaaattgttgacttatcgtccaaataacatgtgatatgtctgcatgattgttatctgtcatctttttagcaattaatcattatattcatgaatgttttttgtttgttccgatatttatcaaaaaaaaaacaaaatttttccatccataccttttccttctgatttgctatgatttcactagaatacatcactaagaatcaacaaatttctatgaccaataaggaatatctgaatttggagataatgcaatagaaatattatgaaacagtttgtaaatataggataatttttattacataacagaaatacctaccttagaataaggattttattgatttttaaatacaatattgtatagtttttatttagtttaggacaatgtacttctttaatatatagttt

SEQ ID NO: 223 - DNA, 2235 bp, Leptinotarsa decemlineata
  Annotation=Novel protein (Zgc:101666); Tribolium gene name from OrthoDB database=TC013998; Blast E-value Tribolium Gene vs. Leptinotarsa Unigene=3E-34
tatattgcccttgttcatgaaaacaacatcctttccctattttagtacaaaaaatagtccagattaatcaaatattttagattaaaataccaagaaagaactgttaattaaactacacacaattttatttacaaatgcttaatataaaatttgaaatacacactaaaattttatattgtgtttgctcaatatcacttccaatttataactgtttataagtttatattgtgtttgctcaatattactttcaattcactcataatatcatcactcagttcaaatctatctagttcattttctgaatctacacataattcaatattcttgaaaagtacgttgtgttcatttataatggacatgggaggagtgtgtagtagcccaccttccatcataggccaaggggaagattttgaaaggagtagcatacaaaccccatatatgttatgatcactgatgtgatgactacaaagagacgatggagaataataataggtgttttcaagatgttctgtacgatgcttattcatgaaactgaaacttccagccgccctcgatctcaagacaccattttccaaatcaatgaacgtaactttcaagtcttcattgacgacgatattatcaggcgaaatgtcagtcaaatacagccgaaactgaccatgattttcagtaaaattataggctgcttgcaataactggtatgccacaaatgctctatcgaaccaagaaaagttttctatatcattcaaaggccttccacaattttcctctatcaccaatctaccacaagctccgtagtaatacggtacaggatagttctctctggagttgaaaatttggagcaaagcaggttcagcgttgattctcagaagggtataaacgtgttcaaaagttttatatttaatatttcccaacagaacctcgaatgtctcattatcacatacacaaaaaggggataaataattatttgttccaacggacatacttcttagcacttccaaatttaaactaccaattactgagttgtcttgctccatgtcgctctcgtcttccagctttttcagaacaacttttttatccttgtacttggcgaagaaaacatttttaacactgaccaaattataaattatgtctgtaacactatcatacgtcaaagttatcaagtttttttccacgtcttggcacatatcgtctccataacagtaggggcacacctctagatgacatagttccattattcgttttatcttgaatgaaaatatcagtattgagaaaagtggaagtagaagaaaatgcactagttttattttcattgcttggcaatgttctaccgactattcttggcaccttgctgcaaggatttctgtctgaacgaatacaactctttcacccacttctctattctggcctcttcgttcaggaatagactgtgatgaaaaatactgtcaggctccagttgctcaacctctggtactttgatagtatttttcctcaagtcgataacaatgttatctggaaccttcttcgctttacttgagctgaactgctttggagtgaaattatcttcatttatttcttctagtactgtattatctacaattacacaatctggagagtttttttcaggcttacaactactttctttagtcgagctctcaacttctttctttgatttatcaattttgttcttactggtcttcactggctcaggactttcagagcttgaactagaactggaacgttttttaggtttactaacaaactctcttatataagattttgatctcgaacgatgggatctgtagcgatctcttgactttgatcgagatcgacgatgccgatctctacgacgatctctagagtctgacctgtgagactttgatctagaagagtggtagtttgaagtgcttttacttctggatctcctagttctaccatatctatccctagacctgtgtctgctgcgacttctcgatcggcggctggactttttctcccttctacgctttgttctagattctgacgaatctgaagatgatgatctacgcttgcatctactacttttgcttgattttttatcccaacgtttttcattttcagagtcactagaatacttacccatcctgtgaatttttatcttatgagaacagaataaaatatgcgactttcttcaacatacctaataactaaatctgagaataagaactaaagagttctaccataacaaaaacaagactc

SEQ ID NO: 224 - DNA, 1306 bp, Leptinotarsa decemlineata
  Annotation=CRSP complex subunit, putative; Tribolium gene name from OrthoDB database=TC002930; Blast E-value Tribolium Gene vs. Leptinotarsa Unigene=8E-17; Blast E-value Tribolium Gene vs. Leptinotarsa Unigene=0
gtttgtttcatgtgttatatctaaagactagtaatgaattactacccaaattcgatttgaaagaaacaaataagaaacataacaagtatatattaaactatataataatatcatttgcattcttcatggtaaggctccagattccttacatctctccatgtcgggggtaaattactgtgcaaatgatttccacatctcttgcagggagcactgaaaagtgtgatataactgtggaaccaatgcataaatgatctcactgctagctctggcatagttggggattggaaatgacacatggcagcatggcagttttcagtgactttcctaaatactttatatcgagactcagtccacaagtcgtttgactcagcatgagcttttactaccacaaactcaaccatcattcctttgaatgcaactattgccttcatcactcgtcccaaagatacctgtataactggattatgaactaaaggtctgcttgttgtaaaagtgacatcaggcagaagtctgtctatactggttattaaattttcaatcacctctggaggtacattatgattgctggtttgggtttttcttctttttgttgtactcaatgtcttgtaggttttattgaaggagttggcagaaagtatgtttccagcaactgcactatattcccgtatcttatcagtccatctgtggctattaactaattgtccatagagggcttgtctttcttgagtagtttcttgacttagaaatgctgtatttcctaaactaaaagcacctggaggtggggtaaggttggcaacagaattgtccacatctctcaaattattattcactgttgtcaggagctcttgcagttcaagagtgaatttaccatcttctccatggtctgctcttaagccattgctgacagactcaaaaacacttcgcacactggacctcaaaactttaacagcattcaaagctgcatttaattgctctatatccctttccataatgaccagaagaatgactgttgaaaggaatgcaaggtttctcactgtaaccttatagtagggcactggggtatttattcaacttgtttccaactattgtttcctatgatgattcaaatttgctggtaattccagttagtattaaagtcgtgtattttactatgtattacctgaaacataaacaaattcaaatttatcacttatcaacacaagaaccaacaaacataacagatcataccttacaaactactttagaatacaggcttcaatgtgtatttatttttttattattagaccttagacctgaaattgtaccc

SEQ ID NO: 225 - DNA, 3384 bp, Leptinotarsa decemlineata
  Annotation=Katanin p80 WD40-containing subunit B1; Tribolium gene name from OrthoDB database=TC006390; Blast E-value Tribolium Gene vs. Leptinotarsa Unigene=0
ttaccaaaataattgaaacaaatgaaaatcaaacatctacaaatcattagtactaatattgaacaagtatattttcacccaaaacccaataatagtttaagaactttttgtcggtggcaagcaaactaagtgtataaatgagagttcaagaacttgttaacataagtttgtttattctatacatttagcatgtggtttcatacaattgataatatacctagtcaactctgaattcttcatctgctgttctaagcgtttgaaattcctctccaagtaaggaagagctgcttccagcaaagatgtcaatcccacaggtctgaaatctccctcttgcaaatctttcatcaaaatattcatcactaatattccagaatgacaattctttccattcatattccaattgattgccatcttgaacaggctttccttttgatcatttcgcaatttttttatggtttctgccaaatcactatcagaattcttcacgctttgtaaaatcatcaatacttgccgaggtctatccaatttcaatgccaacttcagtgctttgaggaaattttcttccatcaagtaattatttaatttttgttcttgtttagccaactcttcagcttcttctatacgtttcaatctcacttcttgagtaacatccttccacttgattagaactgaatcgctaccccctgttacaaaagcagtttcatcttgtttgattgctaaggcccatattcgagcactgtgttgatctagggtgcatacacattcagatgtcttaatggaaaataacttcaacaaaccatcagcccctgcactcaatatttgcatgccagatgcaataaattctgccctaatcacactagcgtcgtgcccttggaatgttttcagacaacttagatctgccacagaccacaacttaaccgtgcaatcagccgatgaggttacaacaacttgatcgactggagaaaatcgaattgaccatactcccctcttgtgaccttttaaaatgcctaccaattccagtgatgttgtccaaatcttggcagtcttgtcttgagaagctgttgctataatcttatcatttggagatactgccacagagttgatatccttttcatgagctattgtagtatgagagcagtagagactattgtttttctttggttcagtggggatttcccacattttcaagcatgtatcttgacttgctgagacagcaaaattacaagtcgtctgactaaaattaactgaacctacagatgcaccatgccgtaaaccaattcctatacagctcattgaatttgtagaagcttccaataaccacaacctgacagtattatcttttccagatgaaatcattaggtcaggtcttattttgttagtgcacaaagacaatactatatcagtatgtcccttcaagatttgacagttcaaggtagtattacaatacaatttaatgtcgtttgaatttgttgctacagccaagtgagaatcatcttttccaacatatgtgatatccagtatttcatctgaaaatcctatgaactgtttcaggcaaacaaatgatttcaaatgatatataataatattctgatcaactgttacaagtgcgagagctttcaactttctgtgaaatattatatttgatatggctaaacatccttcctcggaagcaggtgtcaccaaagaatttgtttgaacaaatacttctttggattttgtaacatcccacactctcactactcctctttcaccagcagatgctacgtaaatactgctgggatcagatttaaaatcaggaagttgaaatttttttggtaagctcactattacttctactgcttcttgtactggtaacgtttttaatggaacagggtttccaaattcccagagtatcaacaccttgtctctggcacaactaatgaaatgttggttatcatgactgaatactacagaagttactttactgtaatgtgcattatagacacatttcaactcccctttattgagttcataacagttaattttgccatcatctcctgatgcaaagatgaaatcatcaatgggatgatattccacaacattaataacaccctgacaacctttcaaactaagaatgcaagcttggtactgcagatcccatatcctgacaatgctatcagatccaccacttgccaatttattatcttttagtgttaatttcgctatggggccaagatgaatatatttccacattttttcaatttctccattttgattccataacttgagtaaaccacttttgtgtgaagacacagtttgttgtccatttgttgtaaatgtctgtattgagtctgcatcttcagagttttcttcgccaattgtttttgaaaccacaccattttctgtatttaataaggaaatattcgaattgttttggcaataaagggtatcttcaaaccactccacattgcctcctgtatagaaagctccatgttttgattccagttcaaacgcttctttcactctcaatttagaccccattctgcggtgattgtattgaattaactataggtaagatccaatatctcaataacctgccacttgaatatcacacatctgactcctctgagtgcaagttaccaactattctatatttctaaaattctacaggtaccaggtattctacgaatggcaatgccactactactttaattttcttataagtatcacctaccattgcagatcaatttaataatgaatgtgattatcaaatatttacattgtcctgcaagagtaaaattaaggcttttaagtggaacagttttgaataaagaggtatcaaaggatggaaattatacccctgtttataaattcccatatataagacctttagcagtggtaaatagattaaaattgtaccaaacaattttgacagccacaagtgtaccagcagtagcaattatgacacaaatgaactatgttgatgtggatgctttaaaagctacatgctttctaggtctttcaggatgcattacactttacggtttaggattcctaacaagcaagttcataggcttcatttattataatgaagaaaaggatgtggcaaaagtagcctatgtggacttttggggaagaaggagggatcttgaaatacctgcaagtgatgtgattccaataaacgaactcccacattcgtatatggatggtttattcctcacattcagaagatattcaactaaacaaacacttcgactcaatatgcaatatggaattatattagataaagaaaagatcagtaaaatattgtagattttttaatattcatttgttgaaactattgaaaatataaatatttcaactccatctataatgggcgtaggctctatttgcctcacattgtct

SEQ ID NO: 226 - DNA, 1905 bp, Leptinotarsa decemlineata
  Annotation=CG6398; Tribolium gene name from OrthoDB database= TC005399; Blast E-value Tribolium Gene vs. Leptinotarsa Unigene= 4E-131
gcaaacgttccgtgttgcatttggggcctttttcacttcattatcatgccctggggagtttaacagtgtttcgagtgaccttaggctgaatttcatgtgtcgtagtgtaattttctagtgatttttcctccgctttattcacgatgccttgttctgctgttaccttaagtttagcgacaatcacttctattatagccgtagctcttcttgcaattgcattcacaacggataattggctatacatcgacgtgaaaaggacgagtatacagaattacctaagcaaacattcagatgcacagagccaagcgctattagaaagtgttaattcaaaatactactactacacaaggacgaaaggactattcaggacatgctacccgaaagagaagcctcctacagtaaagacatatttgagccccctcgaaacccattgcaacaacatcaactattatatccccgacgaaaataacgataccagagatttcaccgacgatgcatggacacgtttacatatgggacgttccatgattgctttgttcatcatatctttcattgctattttcgccgccttctgcacaggagtaacaggatgctggagacgatctcccggaaatatcacatccaccgccatcctgatgttactagcgtgtcttttaagtgctggggcgatgggactatggcatgcagtggaatattacgaaaaagaaaagcaagtgggagatgaatattatcagcaatggagtactatccttcaagaaaacagtgacatatcttacggttggagtttcgtcctcgcctggctgggtgtcttttcctgcctaggagggtcatttctatttttcttcagttcctgctgcttggacaacgaaagagagaaggagaacctgaacaacgtccagtatataatgccagtgtacccacaaaaacaacagtatgcctatgccggctatccagtaccacaaccccagcagcagccttatgcaggaccttattatacaacgggatcagcagcatatggaccatacaactattgaccaactggaacgtgaataatatgaaatgactgtcttccattacctgtttttatttcaatgatatattcacctctcttgacatagaaatgactatgctgcaatgctcaggcaaaaaatatttgcccaaatttttgaagtgtattttcaacatagaaatatctgtgttgaatcgctcagataaaaatacttcgtgtgtctgtgacttctttgtcttcctcgttgatacttttctgaaactgtattggttccaggaatatgttgtttatcaaaaattctgtgtaatattaccttacttttcgtatggtgtttgatattttcattccctctgttttttcaatatacttgaaaacctactggtcaagtataaatgaaaaaatgacattctttgattgaaagtttaaatgtaaataggaagtaggtgataagaaattagttatgtgtaatatagagactgtatttaagtaatatgacatatccaacgaacaactatttttataaatagttattatttatattttgattcgaatattttttctatgtcccttttatatatcagaataggcttaatattaggttagatattaccaatagaaaagtgaattgaaattagggcctttttgaattgttatatttttgaaatacacaaaatagcatcgaattaataaattagtttattggtatagtgaatctagtggggcccgaagatgtatgaaactatgaagagccttatttataacaccttcttatttcaaattctagaaatccaattgatgttatcattcttctactaggaatgtttcaacacaaattcagtcgacatgacatgtgtctgaactattttgttgaaaatgtatttttaccatttcatatc

SEQ ID NO: 227 - DNA, 2774 bp, Leptinotarsa decemlineata
  Annotation=Leucine-rich repeat-containing protein 57; Tribolium gene name from OrthoDB database=TC004931; Blast E-value Tribolium Gene vs. Leptinotarsa Unigene=7E-124
ataccaaagaaaagtatttacacgaactacataaacccaaattacttccataaattcctaaaacattcatcaagaaaaaatgcaatagaaatgattgtataacctagatccaatgtagacatctgtgttttgtactttcgccaccaaggcgctggcatcttgttttgaacccttgaatgtttaaaaatgaatatgaaatacttacttttgaagatttcattgtcatggtctatttctaattcgagatgtcgttgttcttgagcaatatttcagatttcttagatctggcatttgataaacgagtttgtagaagaaacattaatgtttttgctttcacgacttctgtatcatataatgtcaacatgcccaatgtcatattatacgtcacatgtcacaaccacaagtcacttgccgaagtagtagagagtagaggtaactttatttttacaaaataacatttttgttgttaagttccatttgattcacaatgaactgaacggacataatgcaaaggtaaatgactatcagtttattatcttatcaaaaaaatcaacaatcatagtttaatgagcaatttttatcaatatcagctgatgcagataacagaaacagtctcctaaacatgggtaattcaggtctgaaacaacatatagaaactgctcaaaagacgggagtgctcaaagtgtcacaaggcaaattgaacgagtttccgccagggttcaaacaactggagtcatctcttcggaccttggacatatctgataacaaatttgtaactctaccaaatgaaataagcaggttcatgcaactgagacatttgaatttaagcaaaaatagattatcaaagatcccggattgcataggtgctcttacaaagctagaaacccttaatgctagttacaacaatttgagcacattgcccagaacgatttctaatctcatcaatttgaaacaggtgaacttgacagataatcatattaaagatttccccctgatgttctgtggcttgaaacatcttgatgtattagacttgacaaaaaatgaaatcacctcaatacctcccgaagtgtctggtttaaatgtaacagaattaaacttgaaccagaaccaggtagctcatatttcaggacaaatagcggattgcccaagactgaaaaccctgagattggaagaaaactgtttgcagttgtctgcgataccaccaagaattttggcagattccaggatttccaatttttccattgatggtaacttattcgaaagtaaacagcttgctagtattgcggggtatgattcttatatggaaagatatactgctgtgaagaagaaaatgttttaagtaaatttatgtgttcttttaacaagttttcacagattgcatttcaactgctgtcaattgatttaattgagattttgatttgcttggaaaatctttcgctctcctgaataagagacgtggaggagacaaaaagtggttatatgatgatacgtacatactgtgattatgctaacgcataattatcttttacactgtttttcatttagctaggagttgtgactatgtagaagattgtaaaagcaatcactatcaggctgtgttgattgagaaacattccatttaaactaaatgcaacattgagatagcacaatgagccttatgtcgtgaaagtcaatttccagagaagtctcgggatcctcataaatagctgtaaaattttgtgtctactctcttatattatgaatcaatgattactatcataaacttaaaatttagtaatattacacttccgcttctgtgtgatctgaatatattttccagagtatgaggtaatacattaaaaaggcataatcatatgcaaggcagctgaagaaagattcttgattgaacattgggtgtcaattactttgcacttgtcatatacaataagtgtggttgtgttcaccataataatctttcaaataacattgcgtcagttaaattcacacgctaatctgattttgccttctactgaagcttctagttttagaatccattttaatttcagatcactctgtacatatctttttgagtgtcactgaagttgtgatgaaacgtaacaatataatatttcacatcaactgtactcaatatctgcaactaattgtaaaattatcatctgtggtaggcatagtcatgaaatatacgcatgtctcctttaaattagacaatcagtgttttagaaatatcagatgtcaaattattttactctcactgggtccaaatgctgcttctagagccaaggtattcaagaaatgaattataacggctcactcattggttagattactaaatacttccgtttcaatgagggttttgaaagtttcaattttcacacgactgattttcgaatcaaacttgctggctttatgtagtcattcacaattattatgaaaatctactatttatttgtataatgtattgaagccttgttttttattgataggccatttcaaacgggactctttgaaaatctattgtagaaactgttgatatttgaaatggaactttatatctcactcgaaacaaaagtatttggaatattgatttgagtaaaattacaatctgtataattgtgtactttctactttgtaacatatacaggttttttctatgaaatgtattttgtctatctatatcttctatttatattttatatggatatgttgcacatcctactctatattttataaattattataaaactattttccatctgcagaaataaaacaattac

SEQ ID NO: 228 - DNA, 1321 bp, Leptinotarsa decemlineata
  Annotation=Protein msta, isoform B; Tribolium gene name from OrthoDB database=TC005638; Blast E-value Tribolium Gene vs. Leptinotarsa Unigene=0
tctcgggcttggataagacaattttggctttcttgcaacatcgataacatagacttgacctttgttttgattcctaaatcccattttcgcttaattacgagccaattcgcctgaaatagttcatgtaaagtgactccggtgtagagaggtatccttgcatgtccaggatctattttagcattcgtattcagaatctctctacacatcgttgccttcctcatgaggcaatcatcagttatttgacttggagtgtatccctgctggtacccatacaattgaatcaaagagtgtttcacagcgtaaatgtgatagtgattaggatgtaggaatgttagcattttgttaagaagtgtttccaactccctaacagtaggatttgacaactgggtgttatcaacctcttcaccgataccattaaccaaaaaacaaacttctgtgctggtgagtttgacatcacatttatcacaagaccactctgtattgtcatcggttggattcagtggcaactggtttcccccacatggttcctcattggtccccagacacttcaaggcactcagataagtattgagctcagtggggtccacacaacgtttacaatggcaatcgaaatacttggtctctcgtaagtgctctcttctcgcctgagttccccacaaacagtgagtatacatagttgagatatgttccccagattgaatgggaagagctgctttgattgtgattttataactgttgtcaaagttgtaggttgtgtttggtaaacagttgtgttccatgagataggctgttggatacagagctgtcacttcggcttcttgatttatttccaaagcattcacgtcaattattccgcaaatttggtggattgtactttttgatacgtctttcagaacttgtctaccagattttccttcaagaattctcattgggtcaaagaaattattatgaaggtagtcaacgacacgatgttcaatgtccttgtagatcagtgtatcttctccccttttattcgaatgtgattccatattcattatttgagcgaactttttcggatgtctgatttggagtagcaagcacctaagtgttaatagaacatcttgtctgtaaaagtcatggagtccattaatcgctctaacatccctcaatcctaaaaacatacactcgtgtccatgtttttccatatctttcaaaccaggacaattaggatcacagacaggaaagtcgcatccctcacaccggggtgaattttctccaagtatcaatctgcaacaacctgggcaaggaacgggtccttcttcaaccatgtgaggccgtggac

SEQ ID NO: 229 - DNA, 439 bp, Leptinotarsa decemlineata
  Annotation=Transmembrane protein 14C; Tribolium gene name from OrthoDB database=TC008990; Blast E-value Tribolium Gene vs. Leptinotarsa Unigene=9E-31
tatatatacatatatacacatatatatacacatatatacaatatatatactactacattatatccatataaaatatctttgaaaaataatcaaaattaacaattcccagttacatcaactatcaatgaataaaacataaacttaattttgctttggggtaggcaaaatagtagctttcaaaccaattcttataaccatagctagagacagtaaacatattactcccgcaggcataattttatgtgtattgtaaaatcgataacccatgagacccccaagaatcgaacttgttacaagttgtacggtgaaattggagggatccctactgacttcaactgcaccatatgctagtgctccaccaaacaacagaccagctcccaaagatggaatggaaccagctttgtaataaccaaatattccaccagcagccactacacca

SEQ ID NO: 230 - DNA, 3108 bp, Leptinotarsa decemlineata
  Annotation=G/t mismatch-specific thymine DNA glycosylase; Tribolium gene name from OrthoDB database=TC004290; Blast E- value Tribolium Gene vs. Leptinotarsa Unigene=0
ggacgctggcggagacatcgacaatgagcccggagcaaagttccacaaaatacaggcagataacattctattgatttttcaaaacgttcgttgaaccaatcagagagacaggactatttttaaagggtgaggttgttgttaggtttttacaaagctagtgcggacctaaacgtacctaatgtgtgtgcagttttaacatttgtaacgagcgagagctcgttcaacctccgatgcaggtggcaactctttttcgcgagtcctccacgttactgggagcgacaatggaatcgggcggaagcggaggtggccaggactcaggtgcctctggcctaggccctggacctttgccctacgagtcctacaaccacccagtgaccttctcgaataagtacaagctaaatatgaaactggagcctcatgacgatggttatgaaactggtgctgatatgcttttaaacactgccagtatcactcataaccatgaagtaaagtgtgaaaaattggaagacccctacagttttattgatgatgaccctattcctttgcttccttcggcaccggggcctccgcaccttatgcaccctatgcccccaatcaataatcagttgttacctggcccaaaaaaacggggaagaaaaaagaaaattaaaccagaacagcctgaatttaaccaagatatgaatggaggaattccacggcctataaaagaacgaaaaaaacatgatcgatttaatgggatgccagaagaggaggtctccaaacgaactctaccagatcatctaactgaaaacttagatataattataattggaattaatcctggactatttgcggcctataaaggtcaccactatgcaggacctggaaatcacttctggaaatgtttatacttgtcgggcttaaccccacagcaaatgtcagctgacgaagactataaattacttcaagtaggcatcggattcacgaacatggtacagcgtgccacaaaaggcagtgcagatttaactcgtaaggaaattaaggagggtagtcaaattttgttagacaaattaaggaaatttagacctaaaatagctgtatttaatggaaagctaatttatgaagttttttctgggaagaaggattttaattttggaaggcaacctgacgtaattgaaggcaccaatacgcatatgtgggtaatgccgtcttcgagcgcaaggtgtgctcagttaccaagagccgcagacaaggttcctttttattcagctttgaagaagtttcgtgattatctgaatggtctgataactgaaatcgacgagaacgaaatggttttttcggagccaagtttaaaatcttgctacgaggcagaaccaaaaccagagtcattttcaccagaactcacagatatcagtaatggtgtcattcagaacgaagatggtaccattataccatgcaaaaagaaaaggggtcgaccgaagaagataaaaattgatggcgagaaacctcttccgaagccgcacgttcggaaacccccttcggcaatgaataataactgtgattttccaaagaaaaaaagaggacggcctaagaaagttaaagtcgagaatatggatttgaatcagccagataacacatcgaccaacatgtctcagtgcttttcgagtccgtcaccaattcagtctccgaataatttctacccgatggtttctgctatgacacctcctaataactcgagtaacttgtatgctcctcagccccagtcgtataatcagtcgccgaggcccccttatagtcagtctcccaggccgacgtacagcaattctcccagaccacaatacagtcagtctccgagaccggcatacagtcagtcacccaggcccccatacagccagtctcccagaccacaatcccagccttttacccactccgatcttagttcggagataagcgcagccattagttccgagcagctgggctctccggcatctcccatcggcccgcctgactttgagcccccgacgagcatggcggatgaagcagagtgccgcctgggcagtccagccccttcgaccaatagcgaacaaacacactatcattaccagtcttacaacgtggatccccctcatacgcagccagagcgtcagtacccgtctccgcggcaaaaccaggacattgcttccaaaagcttgtcaggtctggaatctctggtggatcagattccaagcataaccgaggccgaggcgcccattggggaagccccagagcagtacgccggtcagttcaacaattatactctgtcgtcctcttcgagagctagtcctgtcccctacaactacccccctagttcaggttatccactgtaccctactcccacctggagtggtcactacgaaccgatgcctctgggctatccacagatcccgtacgcccagaactatgggactggtctgcacgtccccagtcccaactacccgtactacagttacccccaacctacaccgacccacccacccggatatcctccctacttgggggggttctgattggtttcagtcactgtattttcatgttgtgtacctgtaccatatgttcagctagtacctagcaagtctgtccgcttgagtacagttggtcacttgcattttgatgacaacagagacttgcacagggtaaatggtgatatttttttgtcataagtatttttctctaaactttgaatgttagataggccaagggtcttgtgcattattctacattcagatctcagtcgagtgtgtgtgttattctgagtgtgaggttcatcgttatagttgtagcccatgtcatttatttaaaataaacatttgttatagctcttcaggtcgtattttcttgtccttgtcccttgtcccccacatatcactacattcggaaggggtctgtcgcaaaatattttgtaagtggtaagctctaaagaaaaaaaaatgaaaaatactttttatatagtaacagaactgatattatttatttaataattattataacgtatttgatgtgtcattttaaaaaatgtgacttttttatatctaatgttatattaatactcatactggtttcgtattttatgaaacttctattctcaatttt

SEQ ID NO: 231 - DNA, 6102 bp, Leptinotarsa decemlineata
  Annotation=Serine protease H129; Tribolium gene name from OrthoDB database=TC012093; Blast E-value Tribolium Gene vs. Leptinotarsa Unigene=0
acgctatgagttaggtatattttttctatttttgtttgtgttttcaagattaacgactatatgaggttcatcatagttttcgatataattttaaatctattatttactatcttggagttactgttgatcaccacttacgatggcataaggaacgtgttatcggtgaatgtggaggtggacttcgaaaatggcatctcatatgtgagaatgaaaaatcccacagctccagagatcagtttcattagatctgaatgcccatcgaaacaagtactcaaagtttcttgttcagaaatgcagtgtggaattcaaaatacgcatggaccaaccggaattaaggtactgactaagatggcttctcacggtgattggccatggcatgctgcactttttaaagaagatgttcatatatgtgatggaactttggtatctccgaattggatagcaacgtctacgtcttgttttcaaggtcaaccaaaagctgaatggactgccagattcggagttactcgtttgtcaagttcaacgccttgggagcaagagagaatgataatcggaatgataaagtcaccggtagagggcagcaccatagctttgatcagactcaacgaaccagtgatcatgaacgattttgtgaggccaatttgccttcacgatgaaaacaccggcttaatattgaataaagctcattgcaataccttgggatggactagaaatagggaacaaatgcagagggtgcaagttaaggtgactgacatggaaaaatgtgaaaatgtcagcatttcgaatgtgaatagcatttgcactgaaacagcgattggccaaaatgattgcaatgaagaagaatttgcagggagtccaatgatgtgccagaatggagaaaatgaaaaatggacattggttggaataacaaactggaggatagcttgtgcgaaaaatggactggaaaggcccagaatgtatgataaaatttcctcaaacgtcaactggatcagagaaagtatatcttctatcgatacttgaaaaactgttggagatataagtgccaaaatacaataacgagaattgccaaactgatttttttcagactgacaaaaagttttatagaattttcataggttgatgtatatatactgtttgtgtagaaggcagatgaacgattttttatttatactgtgagatgttgaggaaaaagacaaatgttcgagtagttattttatatttacagaattaatttggacacatataaatgatgtttcaataaataattcgtacttattaatagtaccttaaataataaatgtgaatatgtatagatgattcttgaatgtaatttcaatatttaaatttttatacaataaaatttgtacattttagtacttatgatgttttcttctattcaccaatctcacacaaaataagtagtcaacgatatatgaatgttttaacaggatgaatacaaattatcttacctagaaatatgccaatggaaactacaagaagtgaaatatttatagatgggcttctaattgacttgaaaatgttcgacgtagaagaatgttttttttatttttcaattattattcaacttttaattattcaatgaaatgaaaattataatcaatctaattgcttctaaatcaagtaatttacggttaattgtccaactaacaagttttgcaaattaacattttgtgctatttatgtttgtaatgacctggtatgaatcaattttccatgaaatgtttcgttcattggtccattggtccacattgaaaattggttcattctggatcaaacatgaaagagaaaaaaattgtttgtaatattttcatattattaagaggctgtttagctaacaaacgaaatccagcaatttattcccatgtagaaaacaatactttcacccttttcgaaataacaaaagtgggatcagaaaactatcgattgttccgagagaaatgaaaactaaaatcagaccctaccacttctattgatgagaacaatattgtgcgcttattattcgtattttattttaaactgagtttgaagaaagaaactgattttatatgtatagtggaattttcgattataattgaatcttttcagtgaaatagtgcttattcagtcgggcggttataagtaaaaatattttctactctgcaaaactttcgacactttttgtcttttcgaaggatagaattgaaatataattacaataaatccattctttgaataacaataaaatcaagaaatgtcaaaatggtataaacccccattcaagtggagttgtgaaaactagtatgtataaataaataaaattctagaattttttttccctttccatgacaatttcaacaacgaaaaatcgtgtataggaatttttttttagatttagtgaagagatagattattatcagctacggtgagttgttggagaaattgaaggggtacctacagtgtgagggagagtaattctctagtctctgcataaaatagcttatcaaaaagataacgatttagtcttttcaatacaaatttgctacatatatagtgataaataactttatgtagtttcattttcattcattatttttgtcttgtgacaagtatttcatactgtgacattaatattaaaacatgagaattctaaatgttataaaaaaaaatcgactttataggtacttttatatcattgcatagaaaatggaaaaacttcttttcacacatttttttgaatatttcacaaaaaagtgttttttacgaatggtcccattcacccccccttaaactagaacgccaatgccaatcgaatatttttcatttgcgaagtgaagcgactgtcgcaatcgcattttaaacagctgtgatatagcacctttgaccttcgatatctaagaaaatgaagtattttgatcgaaatgttatgaactacaacttatcaaaattccatccaattcgaaagagattcattttccatttgaattgatccttccacaatgtgattgatttaaaataaatctgaaaggttcataaaaaactacctctaaaataaaaatatcgctataatgaaatatatggccttgaataatatttatgataagtattccctttttatttttgtatatgattttctttttttttatctagacagtgtaatgctgattggtggtaatattcaatcaataaattttagctgaataaaataacatttccaaatgaaataagggttgaaaaaaatcggaataaatttagaaatgtatagataagaagttataggagcaaaaagaaatctggcgtttcttgattcaatggctctttcgactcaaaactcaacttttgaatggttactgaactgattatcaaggtaaatattcaatggccgcacttatttgaaatttcagaaaagactttcacgcaggataattaattggatttgtctataagcgcaaaatatgtcccaagtccatcttgaagagtgtatactcgtttagccgtgtataacccgtatatacaaacattttagtccgtttggaagtcatacctttgaaatacaatcgtatgtctgtttttaaaacgtacagagttttgtcaagttactaagcactaacattttcagcaccaaatagagtacgtcatggcagctctgaattgaatatcacagtctgtcacttgttcacggttcaacaaatgaaacactttttctagttgtagaagggtccacagatttcactctgtttatatgcggaggttttttcttcatatgaaaagactgactttctttaagaggagttccagtcatgttataagacatattcagattattcaaattgatcgtgttatttctaagttgatgactgatacttgaatcaatctggacagaattcctcgctggcgtcattggcggtacattgtcgtcagtcgctattcttttgttgcaatctttttctaaggacgcgataagttccaaggtatctcgcgcatcgctgatgaattctgctgaagtattctcgatgatgcgtgtcaagtaataagcctgcttcagaaagaatctagtctgagtttgagatccgattttcgcactgtctttggctatttctatgaagatatcgacgaattgcgttaagatgttcctccttttgtgaatgtcgaattctttttcgcatacccaatccaggttgattgaatcaactgattctcttctttcattttctttcattatgagattcattttgcgctctgtccactttcttctattctctaattctctcaagtgcctcaattgcgtttcggtatcttgatatttcttttgcctcatgttcaagatggcaagattcggtctgaaaatgttgatatgaggcaccggatcgattgttttgtagagatctttgaaatccagaggtgtataaaaatctccgctggcgtattggatatttctcaatgccctgagaaaatacatagtgggggcctggagaacatcatgcaaaactttttgagcgaattgtaaatacatgttcgggatatttcgaaaaagattattatttctgatgaagaaatccggcatgtcgttttgtgccaggcgatctgctaaattgctaataactttgagcaaccttaaacccagacggtgctgaggccagtctctgtagttggcttcgcattcccagtacatgtggcacctgatgtgttccactagaagaccgttatgttttgtgtaaggttcgatgtaggtcttatgcaagaccaacaagaataggaaacatcgcatttgctcgcttgacatcctggcttctaagaatctctcggcttttgggaaggcaatttcccattcgatgctcgcatcggggttttctccttttttcatccaataaccctttggaacagctacacagttcattgaagtgatttctttgatcatatcatctgttggccacttaaaccgaatacccgttctcaagtccgttatagttggcctatcttctctgagtttgaactcaaatgcttgttctgcaggccatggtatctttacacatggtataacctcgcacggaagtggattatcttcctcatcactcaaattgcagaaaacttttcctggaatggaatcagtcaaacttatttccgtcgcatcaaaacctaaagcccttcccacagaattaggaaatagtacgttcttgaagtgattcataaatccctctgcatctatgtaagtcacagtatctaccaggtcctcctccttcagaaccatgttttccccattttcattagtttctagaaggtcagtgtcggcctttcttatttttctggtagtaaaacaggtgttcggtagagtatctcttctttctggttctctttcaatttgtatacgttttggagttctcagatctgtgattgttctgtactcgtacatgtctgaatcggaactgttggaagttccagggatcggttcgtatgtaacatccgtatcatcagggacttttgacactttgctggcatctatgtatctgagtcgaataaaacctcttctcgaagacttttcgatcttgaattgataaaacggtttgtctatagacgtatactggggaatgtcttcccctttgactacttcgattttgtcgtttattacaaatattcttctggcagtcagcagaccgaaagaatgttttttgggaccatgcaacggcctatacctaatgtttttgttcactctgtcgaagataacatccgggcaagtgcattccatgacctcattttggaagagggttcggttgagttctttttccattctatttccatttgcgtgaaacagttgtagcatttcttttgtataattttcaaagaactgcacactcattagcatattgttcaagagaaatatctgcggggaaaatttcaagtccttcttgatttcttcaatggtttcagcatgatatttcacttctgtgtccactattatgtcaacctcttcattttcattagttccaccaatggttactccacgaccgacttcggggttttcaattttcgtgcaagacaaccccattattgaaaacttcagaactcaaccgtcatgatgtcgcccgagaaaaagtatgaaactgactc

SEQ ID NO: 232 - DNA, 2585 bp, Leptinotarsa decemlineata
  Annotation=Protein phosphatase 1 regulatory subunit 3D; Tribolium gene name from OrthoDB database=TC004080; Blast E- value Tribolium Gene vs. Leptinotarsa Unigene=1E-127
gagaatatctagagccggagctcgaccaggacagacctcaagtcgaccacgtgctcgcatgagtgggggtaacaggcacatacaacatgattttaaacttcacttcaaggcagttctctcacaactgtaagtcaggcaagagtgtggtggaattgaggcgcgtccttccaaaccacaaagtggaacacacatcaactaaaaatatgtaacaccatcaatcccagttcaacgaatcagtttttagtgcagtgaaaatcattcaagtgaagaagaaaaattgtcacgagccaagcaaaattttccgaggaataaccctgaaatcagaaagatacaaatgtgttctatggactacgagatgctggtctctcacagtccgccagttttcagtcacagtccgccgacaggaggttttctaacggagtatgcggctctgaggctaggacaagattcattcccgcgcgctgccttcagtacttgccgaaccatccaacactcgaactcattcagcggcttcacgaaggcgcctacaaaaatgccagcttctccgaagcgaccttgtctagtgataagacccaacgaagaatcatccagttcgagcgatgaggacccgaccagtccgacgcgattgaaaaaaaaagtcgtcttcgccgatgacaagggcatgtctctcacccacgtcagggtcatgacggaaccctccaatgtaccgcccctctggagcttccgattcctgtcagaagtgacgcagggtatcaacgcggatccagtcggagaagtagactcttgggaagtaacgtttcctcagcctgcttcggattacgtggcattcaggaagcgactggactcggagaaagtttctttggagaacgtcatcgtgaaggagtgcgaggacaccatcctgggaactattaaagtcagcaacatgtccttccagaaagaagtaatcgttcgatcttcgacgaacgactggaaaacatacgaagactctttctgtgtttatgtgcctaacaacatcacctccagtgttggtcctgcgtacgttttgtacgacaccttttccttcaaaattccccttcccccaaaggtgaaaaaggtagagttctgtgtgtgcttcagatgtgagggaaatgaatactgggacaacaaccatgggaataactacgtcctagtgaaaaagatgcccgttcctttgcacaagtccttgtctaacgatgacttgtataatcggaaaaatagtcaaacgcaacctcaggtaataaaaaagtgcgcggatatagtacaagctaaaatggattcttggtcggagttcgctagttggacacatttagagaactcgagcccttactggtaatgccttaccttactcgacttaacatggaaaaaggcagcatgttggttgtaaaattttttgtgtaatctccgtgaattcaatgttgccaaaacgaagccatcctgtgaggattggatgactgcttttacgtctgggagtatagttactgcgaatttgaattttacaaattttgtctttgttcgcatccggggaatatttggttttttaataagcgatgttcatttagtttggtctgtgactgaaatctgtgatataaaaattaatgacctaacttattaaaattgtggtgaatagaagtgccaaccgggagtgagtatattttgtatggaaattttaaaaaattagtacctaattttaaaagactgatattattatatatgtggaaaagcgtgcaactatgagattttatcgattttgaaaaataaacgaggtttatagagaagtgtatgtatagatggatatatattttataatgctgctttgagagtataagtcaacagtagttccttgctaaacagctcatttatattttcctgaaaaaccattgagaatgaaagtgaatatgctgtcaaaaaatgttgtactgaacgaagatgaaaatgaacaactataattatttcagaaagagaagaatgaataataaattgttacattagataatttttgtcgtttgtagtacctaattaatcatttaaaagaatgtaaactttgaaatatggtaaattgaatttttctgtgtacattaggtcttgttatggtagttgtggaatatttcattgttctctttttaatatttacagtttttttaaaatatgatacatactttttaaaaatagatctgacacttttcatagtttaagcgaatatttcacataatgttgatagtatttattttattggagaaataatacttgacagtgtttatatttcatttttgatggtttttcttttagtttatatctgagtagtttacttttatgtaatattttgcaatgcgaaaaatgtatttttattgattgttgtgtaattatatctttatatcattttttattatttcattgtaaataccatatgtcatttcatgttatacaattctagtgctttttaaagactaatgtgtactgttatcgtttttctgcatatgaatacctactaccttttattgtatatttttcagtacctttgttggttgaacatgcacatttttgttaaataaacatgttggaatattaaa

SEQ ID NO: 233 - DNA, 2214 bp, Leptinotarsa decemlineata
  Annotation=BTB/POZ domain-containing protein 10; Tribolium gene name from OrthoDB database=TC003964; Blast E-value Tribolium Gene vs. Leptinotarsa Unigene=0
ttgacatttttttaataaaacgagtacaaaaatcttaatttacagtcataataagcacacagaaatatttttctcctattggggaagagcattacaaaattcaacattttcagtcatatgacaaaggctcttaaaaaaaaacaaaactgaattgaaccagcaattttatggcttcataacctcatgaggattgtatagattgataatttagaattcgattctatgctcaattcagtgtgtggcctaatagaccttcagtcaactttcccgtacttttgataagaacaatacaacatattagaattaatcctttcattcaatgatcacaataggatttgaaattgaaacaacacttgtttaacatataatttgatctcagtctcaaaggttcagatattagtggacatttcagaccgtgggaatgctagttagacggacttgaatgacactttttgtgagcagggggcacagccaatatcagtgcatcaattttttctctcacggaatacaaagtgaaacgtatcacaattactaaataccgcaatgaacattgtgccgaaaaacgtgattatatacaaaagtgtgatacaaacatgaaatatcatgaaaaaattcttttatattaactatatgtagttttaaccaccaattactataacgtaaattgtcacacccaaacactccaaggataatgagctgctacaacaatcctacattacagcgcaacaaaagttgataatttattacaaatttggctcatcaggcggcaaattgttaacaatatcgagatctggaactcctccgactgccccttcttcattttcaacccccaaatgtacatcgactggcaatacttgtggtattgcgttcatcagcgaagaagcaattggatttcctctagaatccaactctaaaacgggatcagcagtggcctcggccagattagttacgctcttcgacttcacacactggaagtctacgtgtcggcttttcgcttcttccttttcccaggacatgtgaatgaagggcctctggacatagttgtatataacttccgcccttccgcctggacgttttttgactttttccttataggttgggtaaccttcgataccgagacgtatttttttcaaccctctatccttcaatacttgtttggcaacgtctcgattttctatgtatttgaaaaacctatacatggcagtgctgttaacggtttggctatattcttcgcccatttgaggagggtattcttcatcccagtcaacagtatcatcatctaacaagacaacaatatgacattctcggtcacctctttgggcagagttaaccattagaggaagaattagttcttccagaaacacttcaaactgacacctggctccttcattagacagttcatgcaggagacccctcaagttttggcatcgtactgtattggcatcaaagggtacaagaaggtagtcgcaagcttctctcaactcctgtacggaaactgagggtggacacttgatgagacctcctttgtaaaattccaaaatagctctgaaaatagaagctggtatgccttcggctacttcaaattccccgcgatcattaggatgggtaaattctagagatgtgctgaacatccttcctagcattgtatttggatgggctgtgaatattgctggatcaactacgaatcttgtgttgtccacgacaagggttaccctatcctcgctcatattgcctgaaccgttcgtttgggatgccgatttgatggatccagtagattgtataagtgtgcgcgacctattgcgaggagcattgagacattgcttaggcgtagctactgaatggcacctagtttccgttagggacatggacctctgtacaaggcatgactttggcttcgacattgatccataactcatgcgattcttgaacacccttcttcttcgatcatccgtgtagtcttcggtatcactacttgtgtcgttatttggatagggtggtcgatcattagccccagccatttgaacactaggcaataagcacttcacaaacacataaaaataatccgcacaaatttctctggaaccaatccagaacatagaaaaaccctacgggtaagaaaattcatgagaaatttctggatgggtcattttactccaatttttttgtggagaaattgattgataaatctgacacctgacattactttagtatatc

SEQ ID NO: 234 - DNA, 1286 bp, Leptinotarsa decemlineata
  Annotation=Vacuolar protein sorting-associated protein 37B; Tribolium gene name from OrthoDB database=TC014972; Blast E- value Tribolium Gene vs. Leptinotarsa Unigene=3E-66
aactattaaattactatgtttacatgataatacctaaatatacattttcaagttaatttttgaaaaattcattctgttaaaattcatacttcattttaacttcaaacttaacggtaaaaaaccaccccctaacaatttcaaatggggatgcggttgatggcaacttctcaatattttttagtacaaaaaaatataaagcaaattaatttgtgttttctcggcttgttgaacagttctgcagaaatttgagtcaatttgaatttatttttttttgtcttttgttttcagtagacgactgtatttatgcacgagttcttacagttttatcataatcagttcgtaaaaaaaaaaatttacaacaaattatttttttatcaatagtgattttgaaaataattatttctaggtggaggcataggcatattcaaaggacctgtgggataaggcactgaaggaggtccaataggatatggtagtgaacttggagtatttgtgggaataccaggaaaatagttggaattgatgttgactgggggagcatttatgtagttaggattaccaagtgatggatccctctgcaatagttttgaaagtttttctgctttcaccagacgcatatgcataatcttacgcttctctaaaaatgtgtctatgaattcttcaatttctgattcgctgtccaagaatttttttgcaactttgtcagattcttcttccatctcactggcagcagtttgaagcaatgctaacgcggtttctaaggacatatcaccacctttatctctcaattctttggttttttcctcaacacttttcgaaagctgttctcccaattcagatagttcttgaagtttttcacgtccttctaccaactcaggttcttttgataagttgaattcagccatggaattattactggccaacatattttccttctcattttctatttctttcaagtatgactgatccaactctgagaggattttttgaattttctcttcatcattcatgattccatccaattcgtcattattcagatgaccgagtttagctactgctcttttacaatcggcctgtaaaatttctatagacattttaatatgactagttattgttattgtccttattccaaagatagaaaaaaaggttttgacacgtgacaaatcaaatgtcattacttgcctccaacagcttcaaaccgataaagccgctttaccgttcacttctgactgataaacagtaattgttgaatctagcctctatataaagttaaagctcttttgtct

SEQ ID NO: 235 - DNA, 1406 bp, Leptinotarsa decemlineata
  Annotation=Misexpression suppressor of ras; Tribolium gene name from OrthoDB database=TC008033; Blast E-value Tribolium Gene vs. Leptinotarsa Unigene=2E-23
acagacacgataaatgatctctttattctacgagtcataaattgacaatgctaaatatgacgccgaaaacttactttcgacaacactctgtgtacacagaactctattactataatgctaatacttgtatgtacaaattgcgtaaaattaaataataaaataaagtgtctctcagtcatcatcaaataagataaacaaacacatttaaatttcttccaattgatgtatcctgggattcgccaaagggcgaggtaggagttccttcaaagagaaatatctacccgtgtcttgtctgtccacggaggtgatgtgttggaaacagcacggctgcgagatgtggcttttggggggtagcggcgctggtttggggggtttcttttccttcttcttctttttacctggcgtagacagcgatatattttcgggacacgccaccagccgttcaatgtgggtccacatttcgtgggcatgcggcgcgttgtcaaagctgaatcccacttgcagcgtgtggtctgaggagtagcgcatcgtgtgaaacgaggggccgtccactttgtacgacgacaggttgtcgatcgtgtcgctccacagcatgaagcatgttcctctttctgaaagtgcaatctgtatctttctcttgtctctcgcccgagattctcccacgtccaatataacgacagggattcccgtgtatttcagttgccagtcttgttcggatggcgtttttgtgtataaattcgccaaggatccgctgacgtatatttgtgttttcaatcctttgaaaaacgtttcgacttgttgtctctcgatttcggaaatcaatccgccaagcggttgttctttttcctcttcctctctatcaacttcgtcgctttctgctctaccctcgcttccttcttctctttctccgtaactgctccccgaagcggtcgtgctcgagtcgccactgccttcgccagtggaagacagtcttctacgacgttggttgttgctgtaaaggaaatcctgatacgagtcgtacttctgagaaaatctatttatggcgtagtccgcattatcgttttgtttggatgagatcgatagagttgatatgcgtttgtctatcggaatggaagcagaactgctgtagatggggtgttctgctggcattttgatctgtttctgttttatttcgagtacaaaacaattaggtcagcctcgctcttcaaaaaatttcatggcaccttggattagttaactttgtaatgattacgtcactctcaagttgatttatcttcgtcagttttagtagtccttgatcattgcgctgcatttccatgaaactgaatgttgacaactatttcacaaggatataaaaggagtgtttttgttttcaacattgcaagctggaatatttcatttggctt

SEQ ID NO: 236 - DNA, 1355 bp, Leptinotarsa decemlineata
  Annotation=Glycolipid transfer protein; Tribolium gene name from OrthoDB database=TC012160; Blast E-value Tribolium Gene vs. Leptinotarsa Unigene=4E-73
ggtgacgtgacatggtaactgtcagaaaattcaaaatttggaaagtggcttattttttttcttttgatgtaaattaataacaaaattgccatgaattctccgacgcatccttttcacgagccaactgttttctcaactttacctgcccattttccgaacgccagcgagaaaataaaaaccaaagaattcttggaagcctcctcagctgcagtcactgtgatagagcgatttggaaaagtattcgctccagtaatcaacgatatgaacggaaatgtacagaaactcctaagtagatatgagaaagatatagaaggcaatgaatacttggaagatatgattgtcagggagcagacagagggcgaaaacgttgccacagatgcacttatgtggttgaggagggcacttcacttcttgtcccttttttaccagtatttaatagaagactctagaaatgatcaggcctccagtgatttagctccgcttttgaaaaaggcctattccgaaacattgaagccctttcatggctggctaggtagtcaacttttcaacgttctctcgaggtttgccccccgcagaaaaaatctcatcttcagcttaggattagagaaacccaacagggaccaagacgttatgagagacctggagacttataacagcaaaatggtgacttgtattcgaagactgacagatttttacacagagtatgccttggagagttatggtactgtctgattgttttatagagactgatattttagatgatgattctaatatggctatctcggaaataataagactcaaaaggtatgtaatgttagacgaaagaggactatttgtggagatattaaaaaaatacatgtgttgtggtatatgaatttatgatgatagtggctactacaattgatgaaactagatatccgtattgacaaaaattatgatggaaaacaataaatcaaacaacacagtgaattggattgggtagtcaaacgaattccagcaaatttagttttttgtgaataactcaaaaacggccattgttagtctcgatctgtaattgcgaatagacaatgtttatctagttcaagcaaccttgcaactctaatcagttctgagatagcaacaatgggatcagttaaaactaacgctctgcatattgttagctgttgattgacaaaatattggtatcattgtaaaatatttgctggtcgacagattttaagatgtgttggagagttgttactatttcaaatgttgagggtagatagtttttatatattgttacatgctgtttgacaaaatatttgttaatcattaaatatgatacatataatgtttggttatattattattgtaaa

SEQ ID NO: 237 - DNA, 2658 bp, Leptinotarsa decemlineata
  Annotation=GMP synthase; Tribolium gene name from OrthoDB database=TC030725; Blast E-value Tribolium Gene vs. Leptinotarsa Unigene=0
aaacaatcatatttgtatcgtaaatcgtaaatttcggcgaacgataaactaaaccaataaacaatcttctgtttaatatgttgaaatgatttgcattgttgttaactaggaagacgtttagatcttgaaaaaatagaaagtggtgctttggtatcaacgagctatggatattccgaatccaggatgtagcttcactgtaaatggggccacaaatacagagaaactctgcatcttggatgctggcacacaatatggaaaagtgatagataggaaagtgcgggaattatgcgttgaatcggatttacttccattagatacaccagccttcagaataaaagaagaaggctataaagcaataatcatatctggaggacctaattctgtatatgccgaagatgccccaagatatgatgcagacatattcagaataggattgcctgttctaggaatttgttatggtatgcaaatgatcaataaggaattcggagggactgttattagagaaaataccagagaagatggagttttcatcatagaaactgattcaaaatgttttctattcaaggatctagataaaatgcagcctgtgttattaacccatggtgattcaatagataaaatagcagatagttttcgatcaatagcacatagttcatcattttgtgctggtatatggaatgaaaaactgcatttgtatggccttcagttccaccccgaagtagatttgactccaaatggaaaaataatgttgaaaaactttctattcgacatagttggattcaccggcaattacacaatccaagaaagagaaaaagaatgtataaaatacattaaagacactgttgataacaataaagttctgttgttactcagcggtggtgtggatagtacagtttgtgcagctttattacataaggctttaactcctgaacaaattatagcaatccatattgataatgggtacatgagaaaaaatgaaagttctaaagtgcatagcactttagtgaacatgggcgtcaatttgaaagtgataaatgctgctcccaccttttctaaaggcacgacaatagtcccgcttgacaaatcaggaagtaggagaactatagtaactaaaacgttatgcatgaattataatcccgaagagaaaagaaagataataggagacacgtttgttaaaattaccgacgaaattattgcagatcttaatctcaaccaggagcaggtgtttctgggacaaggaaccttaaggccagacttgattgagtctgcatctaagttggtatcttccaaagcagataccattaaaactcattttaatgactctgagcttatcagaaaattgcgtgaagaagggagaatagttgagccacttaaagacttccataaagatgaggtaagatctattggaagaaatttgggtttatcgcctgagatagtaatgaggcatccttttcctggtcctggactagcaataagagttatatgtgcagaagaaccttatatagaaagggatttctcagaaacgcaagttttagcaaaaattatagtaagatttcatgacatgttagagaagcaacatgctttgttgaatagagtagagggagtaataaatgatgaagaaagacgtatgttgaagcaaatatctactaagcaaaaattagttgctactttactaccaatacgaagtgttggagtccaaaagggttgtagatcctatagttatgtagtgggtatatcagctgaaaaagaacctgatttcaatgagatgatattcctctcttctatgatacctagaatatgccgtaatgtaaatagggtgtgttatatttttggagacgttgtgaaagagtctgtacaagatgttacacccacccacctgactaataatgttcttagcacattacgacaatgtgatgatatagcaactggggtattgtatgatagtggttatggtcaatcaatcagtcaaatgcctgtgatattaatacctttacattttgaccgggaccccgctctgagaattccttcatgtcaaaggtcaatagttcttcgaccattttgtacacaagactacatgactggtgttccagccgtacctgggaaggaactgcccattgatgtggtacataaaatggtccaggaagtgacgcaagtaccaggaatcagcagggtactatatgatttaacatcaaagccgccaggaactacagaatgggaatagacttaactgattttagtacaatatttttgttcatttatgagttgtcttttcccaaattgaaaatgtttgtttagttggagataacgagctccccaagttcgtgacgcttttatgaaaaaaaatcaagtttaagtttggttgttatgttgatttaaagataatttcgagacttgaagaatatttttaatctcaaataatgtctgttctgatttattactgaaacatcgtccatgtctagataactttaaaatttaatatttttatactacgttacaaattgtttactcccattggatagaaccgctcttggcagagaggttcaaaaatatgttattttctgttatatttccatgtatttcttgttgatattactttcttatgttttaagtgttcatgttttgtatgctgttcgaaattttaacaataaaaatttgttt

SEQ ID NO: 238 - DNA, 1024 bp, Leptinotarsa decemlineata
  Annotation=Isoform 2 of Pre-mRNA-splicing factor ISY1 homolog; Tribolium gene name from OrthoDB database=TC012663; Blast E- value Tribolium Gene vs. Leptinotarsa Unigene=2E-68
ttgaaaataatatattttaacatttacaataaaaccaaagacttgataatacaacatagactttgaatttttatttctttgaaacacattattcccttagagtctattcggtatgtgccgttacgacggggtctcatctccaatcccgtattttgccatcagctccagtttccttcttttcaaaagggcttgctcgatatcttgttgtgaaggtacaggtacatgcgcaacaaaccttttttgtgagccatcttggatagtgttatcggtattctcctcatcggaatctgcaactgcatatatattttcttcctcttcttcttgttctgtattgtctgattgatttatcctttgctcttttttgtccttccaggcttgaactgctttttgaatggcaattttttctgctttctgttcaagcggtatgagaattccatcatcgtcatccatgtacccatagtaatctgcgtcgatgtctttcatcagttccgctgtagtctttcggggaggaggcggcggctcttgttcaaacaactcgcgaacccctggcaattctttcgcagcaccgaaatacttgtaacccctattccctggaacctcttttccttcattgatccagcatacgaggccccactctctgataatctggtcctcccagctcttcaatctgatcctcccagtggcgcttctctcgaagaagtttgttaatttcatcattcaggtctcttattcgaaattctccaagacccgcgttttggatttgagcaactttcttggcaatttctctaatgatctgcattcgccacttttcacaagcatataaacttttacattccgatgctaggtaaggcctcctttttttgtgcttttctgtttctcccaactgagctgctctccatctggctaaggtggtcatagccttctcagcgttacgtgccatttaatttcgtcttttcgggcactaattgtaacaaaactatatttacttctatacgcacaatttgtcttctatacggtcccgaaa

SEQ ID NO: 239 - DNA, 1517 bp, Leptinotarsa decemlineata
  Annotation=Glass bottom boat; Tribolium gene name from OrthoDB database=TC004299; Blast E-value Tribolium Gene vs. Leptinotarsa Unigene=4E-12
tccaaaatattgtcgattttaaaaggttgacatgtttgtcaataataaaataacttatcaaaattgataagtttcataaattttaatttctacagatacgaagactcaagctgtcgcgtcgtcactttatatatctgagttcagaagtagataccacttagaaattttcaatcttttacctaaacagcactgtttattacataatctcactgcaatatataacaaaatcacatctcaatgacagccacaagtcttaaccaccatcttcttgtatctcttcagaataacgttttggtcatccagaaaatacaaaactgaaatcggtcctaactttgtcggcgcgcagcatggtttagcgtacctccacggattcatcaagtggactaaggtctgtacgatcgcgtgattggttgcgttcatgtgagcgttcagaggaaaattgcattccccaacacaatagtaagcagcgtaaccttcaggagcgatgatccagtcctgccatttcaaatctttgaaactgatgtacaaagtctcgattctgcaactcctttgggccggtttatttacatctctagagtaatctctcatcatgccatccaacgtgtctttcttcgttctggtatctctggcaattctaggtttcacatggttaacagctttgagaaaagccaccatgaatggttgcgtttcgtcgtctcctttcacggtgaccaggcccagatcttcaggtcggatctcatgacctggcttgtctgcaggatgtactgaaaggtaaaaacccttattggaatccgggaaagccacccaagtagctagacaggcagttacgttgagacttatccatccggtgaaaccagaagtggtattttgtgcagagatgtattctagttctctttctccatcgtcagttttaatcagttggtaaatggtgactgtatacttatagtccgggttcttagtatattttccagaagttttatgaatcttcagttcggctcccacaatatcttcagcaacaggaacatccgaaacgttgaaccaaagtcgtttacccctttcgtgtctaacgccaggtacatggttactgctactttcaaaagtcattatcacatcactttcgtcgatcttgttttgttcctccccgctaatgtaaacatccgtactacgtttcctcctggttttcccctcgtgctcctcctccaacaaggattcgtagatgtcgagaagaaatttcaacgccgacttgttcagaggctttctattcactttccttggtcgacggggtagccctaggaggttcaaaatctccaactccatctccttcttctcgtccaccgtcatgagcctttccatcgcagtttggtcgaacccgttatcgaggtaaatgccagatttcggcgtcgaggaagcggtccacgaattcgccagaaccagacacaccagcactatcgcacaccgcatttcagtgaattcacttgttcaattagagttgatcaacgcctacgcggtatttaaaa

SEQ ID NO: 240 - DNA, 1539 bp, Leptinotarsa decemlineata
  misc_feature (57)..(57): n is a, c, g, or t
  Annotation=E3 ubiquitin-protein ligase CBL; Tribolium gene name from OrthoDB database=TC003318; Blast E-value Tribolium Gene vs. Leptinotarsa Unigene=0
aaacaggtaaacataaagcacagccgaagttgaaagggcacaggagaagaacggcanaaaaactttttagagacgtcagtacaacttccagaacatgaagaattaaagaaaatatatctgatcttcgttgtaaaatgtttgacatctctataaataatttttattcagcataatcattcgtgcttgacttatcatttgctacctctaactcgaagtcttcatcatcaatgtttccggtatttccagaggcggtcgtaaacgtttttcgttgatgggatttcttcgggtcaaaaggatccacaacaatctgctcggtgccttttatttcagccctacagaagggacaaccttggctgccttggccctcggatcccgcttgccaggccgtgaggcaaggtgtgcataacaggtgctgacaaggttcaatgcgtacatctttgtcgttttcggcacaaattttacatagttggaatgtactacccatctcacagtataactcgtactgctcctgagtaacagcaatatggtcttcttgactaggctggacagcccatgatagatcagggttgactgatctgccatcggggtagagatagaatccttctcgatatccatccaagagagcttgtatcagacttttattttgcggtatggtttgcagaatttcgccgtctggcgttacgtagcctattgcccactgccccaatctggtgcacgacaacctgaacacataacttcctgccttattgatgtacttctgaagacgtgccttcacttcatcatacgtcaagaatgccacataaccatgatgagtaacggccagtatcttccagttgctgaggagggtagcccaaggttgaaacaaccttgtgaagacatcaaattcaaaatttgatatgtaatcattacaagtcaggtcgatggtggatttcagagctagcgcttccagaccggacccgataggatggattttattcaattcttgtttgagaattttccaaggaaccaaagtgctgttcccaaaatttgtcttccaaaaatctgcagcatcagacttagtaatcctaaacgtatcaccagcaaacactccattcgggaagagagctttcaattcactcaacatatgactaaacactaaactatgttttgttaagttcctcctatagtgagagttttcatcaaacattttttctttaccttccttgaacagtttaattgtttgcttacacttccgcattaaattaataataaatatattaaagtgttcaattgaatgtagttctcccatattatcttcatatttagaataaatcagcctcagtctttgataggtgtctggcaaaatatctaaaataaatgggggcgaatttttcaagttcattttctgatgttgacacaatttcacaactttatccattagtttccatgttttatccaaagtccttttgtctgtcgagtattttggatgtgttaccacttctgaaaaagcgccctgtaatttggaaaatatcgtcgataggtttttgtgcggtactggac

SEQ ID NO: 241 - DNA, 1680 bp, Leptinotarsa decemlineata
  Annotation=Glutamyl-tRNA(Gln) amidotransferase subunit A; Tribolium gene name from OrthoDB database=TC013788; Blast E- value Tribolium Gene vs. Leptinotarsa Unigene=0
acttcttctaaagatttttaatgtgtttattatcaatataaagacacttgtaataatcacaaattataacaaatatgaggaaatttaacagcattttcaatatacttggctacagcgagcagtagtggttcactcaaatttttacctatcagttgcagactcagcggaaggccgtttttggataatttaacgggtactgagatagcaggaactccagccatattagaaggttgcgtgcagtaatcctgagtcgcacactgatccctatttgttctttcaacgaacttactgtacaagggggcttccgacagggtagtaggcgtgagtaacaaactaacatcgttccacacattgtcgaaatcatttgaaatcaatctcctagttttgagagcctgttcaaagtacttcttgtaattcctagaaagtagaaaatagtttcctgttagtattctattcttcacgacgtcattgaacccaaaacgcctactaagagcgtacaatttttcagtagacgaatgttcatctgcacgaaaaccatattcaatgccatcatatcgagccatattactagcaacttcacactgattcagtatcgaataacagacgatactgtgttctgtgttgggcatcgagacctgtttcactactgcaccttcttgactcagaaatgcagcaacctcattccaagtatccgagacttcatcactgagatgctccgagttatactccaatggtatgccaattttcaatcccttgatgctcattttttcagcaggtggtaatcttacttttcgatatggcttggtcagagacgtcgagtctttgggatcaaaccctgcgattatgttcagtacagaaactacatcatcaactgttctggctagtattccaggtacgtccatcgaattcacaagagggatcagtccagagcgggacactagtccgtatgttggtttcagacccactatgccacagtaagaagctggatttcttgtggaaccaccggtatcagagccaattgcagcaaagcaagttccagaagcgactgctacagcactcccaccgctactgcccccacatatacgaaaatcactatctgtggaaccccaaatgtttctggtaggtccaaatattgagtcaatggtacctgaacccattgcgaattggtccaaattcgttttaccaattaaaatagctcctgcattggcaagtttctcatatactgtggcgttataagcaggaacgaagttttccagcatttttgaggcacatgttgtttttatgttttctgtgcagaaattatctttgattgctataggcagaccatccaagtctgataaaggtttttttgctttatacctctccaaagagttttctgattgagttttggcaacttcattggtaattgtaatgaaagcgttaaggttttggttttcataagccttttttattgatgattttgttaaatctgtaggtttgattataccatcaaataacagtctagaaaccgttttaatgttagctgtggctattttgtccattataacgtgttttcaagtcaatgtctaaaaacatgaggaaatttataaattcattttaaattctgtttaatttttctgggaaatgttaaacataacctaactaccaatgtaaacataaccacagcttttcagctctgac

SEQ ID NO: 242 - DNA, 908 bp, Leptinotarsa decemlineata
  Annotation=HIG1 domain family member 2A; Tribolium gene name from OrthoDB database=TC011809; Blast E-value Tribolium Gene vs. Leptinotarsa Unigene=6E-31
aaatcgtgcgattaaccaaatacattcgagagtaacgtttcgttactcggtaccagaggacgcacccgttactcagtaccgaatacatacagtttgctacaggtctattttgaaccaatcctccttcaatatatattctacttttcagaatatataaatttataagcctatagaaccttaaaatacatgttgtatctgtctgccatcattatcaacatccactttgttttgaaatgttacgttctctcttcagcttttcgtagttatcatgttcctaggtcttattcaatttaagaaacagtgtcactaaaacaaagatagcttaaaattttccttttgatctctcatacatgcttcagtaaggataagaacttgataattcaataaagcacagttgttatgtgcaccaatggaagggataatatatctattgtaatattggaactaaataatatcaacctttctaaaattatatacagtggctacatacaatgtctaaactgaattaaattttgaagtttttctgtgcagtcatagtgacaccagccaccatagccagtatggtgaagccttgagcaacaactcttgttcgcatcatatactgtgacatctttctcttgccagttccgagacaccatacaccataactgagagctattgtggttgcagcacatccaatgggaacgaatgggttctccttaaactttcttataaatttctcagtaaatgtttctataggaagggcagcatccatgtcttttctcaaagttaaccagtcaaacttttctaaatcttcttcggtgaaatgtgtgtttttcgaagacatattgttgttttaacgttatttaaaagtagacccaaaattaaatcaaattctaaccccagatgtcgaaaagctgtcggatgtc

SEQ ID NO: 243 - DNA, 1713 bp, Leptinotarsa decemlineata
  Annotation=Ubiquinone biosynthesis methyltransferase COQ5, mitochondrial; Tribolium gene name from OrthoDB database= TC015302; Blast E-value Tribolium Gene vs. Leptinotarsa Unigene= 2E-121
gactgtggtctgtggtagagccaaagccaaaaggaaaaaggacccgaaaatttggagagcaagtagaagctgtcaaaaatcaaaatgaaactgaccaaaaattttaaaaaattcctcaacaattctggtcaaatttgttttagaaaagaatttaaattttttttctcaacaaaatgtggagagaaatacccactttggatttgaaacagtcaaagaaagtgaaaaagaacacaaagtacacaaggttttcgaaaatgttgcaatggactatgatattatgaatgatgcaatgtctttagggatacatagaatctggaaggactattttatgtgtaaactgcatccaacaaataatacaaaattgctagatgtagctggaggaacaggtgacattgcattccgatttctgaattcagtcaaaaataatcaattgaaagactgccatgttactgtttgtgatataaatgcaaacatgcttgaagttggcaaaattcgaagtgttaatcttaaacatagtcccaataacatcacctggaaagagggtaatgcagagatgctaccttttcatgacaaggcgttcaatgcttacaccatagcgtttggtattagaaattgtactcatattgataaagtcttagaagaagcctatagagtacttcaacctggagggcgtttcatgtgcttagaattcagtcatttagaaaactctacagcacaatggatatatgatcagtatagttttcaaatgattccagttctaggacaagtcattgctggccagtggaaaccttatcagtatttggtggaaagtattagacagttccctcatcaggacgatttcaaattaatgatagaagaagctggtttccgccaagtgacatatgagaatttgactttaggggtggtagcaatacattcaggtttcaagttatgagaaaatcaacagaattatcaaatgaaactttatttaaataatcaattgttatgcacatttcgaaaatacatcaatgttttgttttacaatcttttgtcaatttgtgttttcacacttggaatattttttatagtaaatgacaaaaacatgcaagttcctccttacaaatatattatcaaactatttacacagacataaatgagtgttccttatcttccacgaccggtaggtgcaccaccttgctggttctgccaagtacctccccgaccaccacgcatctgaggctgctgcccccgtcctcttccccgagcttgtgctctaagtattgcagattttcctctccctgcagttcccgctttcgtctgctttttaaacattggagcattcttcaacatatccggtagaataagaaatctgatttttgatcctctgatataaacattttctaactgggctaccctgccatctcggtatgtaacagtgatttgtgtcatttgacaattcatattatcttcagcttctattagttttcctctgtagacttcaccggtaatagtttcacaggttacaatatgaccttcggcttcatgaagaactttaataggaacaccaatagacattttggttaattggagatggaattctcacacaatttatgtgaaattgtagacaaatttatagatgaccgaagattcagaaatatttactttattcgtcaatttgagaaacattggcggcttggatacacactcctgtcatctgtcaatgttttaacatgt

SEQ ID NO: 244 - DNA, 3555 bp, Leptinotarsa decemlineata
  Annotation=Hamartin; Tribolium gene name from OrthoDB database= TC002959; Blast E-value Tribolium Gene vs. Leptinotarsa Unigene= 0
gtaatatatatttaataaaaattgttttcaaactcaaattaatacaacagggccattcagctataacaatttataggtattttgtcgatttgactacgaattcaaaaatgccacacatggtgtggcccatcaattataaatttgtaaaagaaaaagataataattgtagtaggtatatgagaagagtactaacagattctcctcgtttttgtatccaatttcagagtataaaatttatatttgtatctaaatcagtatattaaacaggagacaaatcaatgttctgaaaatataactagaaaaaaatcagtcatttttcgaggaagaagcctgccacatctcaaattctgcatacccttcaccataatcgcctgactttgattttggcaaaacttctttttggtccactagtgcttgcaagtttttcacctctttttcatgaaaagctgcgctaccctccgaagatgccaacgatgccgatagaggagaagaatgagggctgaatccagcagttgttgttacattaacttcgtgacagctactcgtgtcaggagaatgaactgagcgttttcctctctcaaattcaagtcgttgccctaaatccataattctttcttctagagctctgcttattattagctgagtctgatatttactttccactgcctctaatttttcaaatcgttgttcatttacttcctgaatcatctgcttcaaagacaaaattaaattatccctttcgagtatgatatgctccatctctataaccctatgtttgtatgcttctaaaattcctacttttgcctccagttgttgattcatggctttaatctcttcctcacatgccttcttcaactcctccacctcatattcattatttctactggcagaaaaagtttctatcctcctcatattttctaattgaagttcgcctattaaaagtagttctttatttacttggtccaattctttcttgactttttctcctgctaatacctgctgcttagcgattgtaacttctgcgactgcatccaacagactggcttgtgtttcatgaagtttattattagcaacagcacaattattttgcatttctttaaggtctcttgataaaacttcgtttgccactttcagcatcttgacttcattcagtatcattttactctcattttcccaatagtgaatagttttgataaactttttttcttcttccatcctttcctttttgtaattttcaagctgttctcgtaaatcgtcgaagtccttctgctggagctgaactttatccctcaatgctgaattatgttcttctagtgacctggaacttttagcatctgagagtaaacgtcgattcctatatgcatgtgtttctcttctatgtctctcaaacaggagctgttgatgcaccagttgcaattgttctttcatgtgtagtaaactatttttatcactacattgtacggccatttctacgtacctatctaaaatatcataaatagaagaaggaagtattcggtcatcagaaacggtaaatggcgctggactcgaatctgaactacttttgatttcattattctctaaagatgggaaaacacccaggaacaaatgctcatacggccagaaattttcagtttgcgttgcacaagaattcaggttttcacgaagcctaatttcaggtaagttcaatccattaacattttcgaaatcaccctcaagtttttcctcagaattttcttcatcagtttcatctaatggtctactaatattgtcttttgttggattaacaggactttttttcatctcaggacatgacaccgcacgcctcacagttgtactgctgggaaaagaaatactatttcctggactgctgccggtagaaatttccattttatcgagttcgggattacactgactatggtgccttaatcgccgaacacgctttgaaaatttatttattgatttagagtttggcatatggagacccccagcggtacaaggtgacccgtgttcttcttcatctcctaatttatcatcggaaacatcctctaaacattgagaagttgaatcactttctgaaggtctgtctaatttatttctaccaaacatggttaggacttcttcatcatcttcatggctaacaggagattcgtttctttggtttaaattagaaatctttgattcatgacttgttatacactgtggactagaaggttgtggtaaatgtttgctcttggctaaatctgaactggtctgggttgcacttgtaactggaacaggagttgattctggagttgcttctacagctgcttcaggaggagacgtaccctcatgggacgggaaattagaagatgcatcctgcggatgaggaatggtggtaggaacggattctataattggcggtgaatggacagtatacatcatacttggtgagaaaaaaggcccagtatcagaagcagatttttcaacaaacccttcatttttcaaactttgaagattataagatttttcaattgtggaatttgcagttccagaacgagatcgaaaaccagatgtgtactgacaagagtcatgaggacatctatcagtcaaatctaagctgaatctttcacattctacaattacatcatgaactcccatttttttccacctttcagtggtcgtttctgtatcttctgaggcagtgacaagggaaggatgcatccttacagtgtttagcattggcttgatagtatgaacaaaaactggagcatttttttctttatactgatttctcaagtatactaagaaactgcaaggaaacattccatataatctcagaaataaggcatataaggccacctgcatatgaataagttgatcttccacaattttcccaggattacaattccaacaggccaaacggctgaagatgtcaaagatgtcttttaaatattgtcccattacagatggtatcataggcaataatacaattaaaacaagaagggcacttattaatggtaaaagctccacttcattcttcagtaatttcagtaaatctttcaggagacaatgttcttgaagtttataaagccacgtgggctgtctacgagcgacataaccaaaaagagtgagagcctgaactttagtatctatttttgagcctctcatagaatctgataatcgatcaaataaatagttgtgatggggttcattgatattaaccagtatctccatcgcacgttctgatcttgagttcaaataatattcgaaaagtccgtttaacagccatgattcattaactttcgtaaactgttctctgatactgtttattgcatattctacagtttgtttgtcattggattctagacgttcgaagatgtcagtcatgatgaataaatgtgaagtggaattaagcagagctggtattaaaatcttttgaaattatgaggttagctgctcattttagtttttgatgtaaccttgaattcaacatttgtttgattatatggaaaagtgaaataattattgtaccgagcgctaaaatctggctaaaaagtgaactgctgagctgagagt

SEQ ID NO: 245 - DNA, 2974 bp, Leptinotarsa decemlineata
  Annotation=Raf-like protein serine/threonine-protein kinase dRAF-1; Tribolium gene name from OrthoDB database=TC005910; Blast E-value Tribolium Gene vs. Leptinotarsa Unigene=4E-54
attttcttgatttattgtaaaaacaaaacttttgtataatttaaatatacattagtcaataacttaaattaaaatcacctttgcacatccaacttactcaaacacacgatcacaactacataaataattacttgctcagtatctatagttcatatacaatgaaataacagaatatacaactggataaactttttgtatctgtaaccattagaatattaaaatattgacatgttgacatcctttgggctatagtgaacctaacctcaaatcgcaatatcttataaaggtttctttgatatttatttcaaaaagcatttgatatttactattgatgaagtttcaaattacacattcaagaaaatgtatgtccacaacaaaataaattttcaagtttctatattaatcaatgacccatcatgaattggaaaacaaaatttaagttgatataattttctaaatgagtatctggtggaccccatatgtgaatcggtcttgaatctgtgtgaaatattccaaaaatctcaatgtttcaactctactcaaatgaaaaactcaccctacttctttgaatagtaatgtgtttcctgatgaaactctggttaacgaaaaaacagaggtttttcaagttataatgtgaatttattcaaaattacaatatttagtatcattatggggaattgttaatgattcagtcacaagtcccttaaactttttgggaaataaaacaattatatagatattcaaattagcgttatgttatctctctcccaatttatgtactgaaaattaacttcttgatatctcctctctgtttaaattgaaaatatgtatattaattcattgtgttgttaatagaaacaaacattcatctctgaaattagaggctgctgaaaccttctatgaatgtcacactaggaaatccaaaaattctattaccaataaaattgaaacactttcacataatgttatttataagaaattaccaattacttcaaaacttctctagcatctgctttcttcaaatcaatatgtattaaatgttttgtattattatttaaaaataactcatttcatattgaaatttagttaaggtccctgatataaacatttatgtttcttcgttaaatgaaagtcaactgtttctcatgagattaatttttcatgaccaaaacagcccttaatttattaatatgtcttatctacagacacctgatatataatcaactcaatctctagcatattttcctatgtaaaacaaaggaatatcagttttccaattcatcaaattggaatatctttcaagacctttcaagtgctgaatcttcaaggatctggaaaacaaaaggaccaccaatcatctcaatcttgaacaattaaaatcggtcattctgaatgtgatgttttcataccattcatcaagaaatacttcatcaactgatcccgcaaaatatcacttagttcaagaccaaacaatttatatgttacccgtacctgatggataaaacaaaaagctactcggtccaaaattgacaggtgtcttgggactcatacatgtataaatgaaatcgtcagattgtaaatgagttcgattcatgtttggttccgacgtggaacggctaatttttggatggtttctcaagaatccttcaagagatgcatgtatctgtctaaacaaaggtctttcgtccctgttgaattttatacagtcttccgttaggcgcctaagagccttgggagtgtctgatctcagtttagtgaggtccggtttgagatagccccttcctaccatgaagagaatttgatctttgttgttgacatgagcgtaaggcaattggcctgcaagcatttcaaatactacaatgccaaaagcatacacgtcagactgaaaactgtagggattgtcttcctgcattctgataacctctggtgccatccagagtatggaaccggtaggttgatggaactgctgagatccagaccacctcgtctttgctgttgccagaccaaaatctcctattttcaccgtcaagtcatcatgcaagaatatattattggttttcaagtcacggtggattatatttttagcatgtagataatccataccttgtgcagtctgtctacctatctcaatcaaagtgaagagttggaattttgtttcatgaacgtgtatgtgcttgtagagactcgatccttcacaccattgtgtcactatagctaactgaggtttactgacgcatcccatgaaaagaagaatatttacatgtctagtttttcgtaacacagctacttcgtttttgaaagcctgcaactgggccatggtaggtattttcacattgagtgtcttgacagctaccggtccatgccagtgagccttgtatactgttccaaacgaaccagatcctactctggctcctactaatatttcatctgcaggaatctcccagtcttcgatgctttctcggggagcgagaaggggtttactttcatctgctgaacgagctctgggtcttccgggctgaagagatcccgttggtgatgcttgggtgctcctgcagtgtggagagccatctacatcagcaccagaccttgttaacgataatgaccttgggcaatcttctccggaacccttgacgctatttaaacatacgttgggagctgaactggatctatcatggtgaccaagagtgcccggatgcctgggttgtcttagagaaattcccagttctgcttgccctgcataaaggataccagcacttgtatctggaggtctggcaagaagtgctctgtaatatgcatctgccattcgtacttgatggcataaggaaggaacaccagtagcacaacgatgatgaaatttataaccacaagaactccgaaacatagagaatgtaatcagtctgaccagaacaaacatagatgccctaaatgaaaagtttgccgactttcagcacccgcctgcaatgtacctcaaaga

SEQ ID NO: 246 - DNA, 1282 bp, Leptinotarsa decemlineata
  Annotation=Mitochondrial carnitine/acylcarnitine carrier protein; Tribolium gene name from OrthoDB database=TC012546; Blast E-value Tribolium Gene vs. Leptinotarsa Unigene=1E-113
tttttttcactgtacacaacttatactatatgtttgtcaggcggttaaccaacagtgcccaagcacatttcacttgaagatgacacccaagcggtgaattttacgaaactgctagttcaccaaatacatctgcacattctttcagcatcgattctgttttctccacagtttccacgagactttctccgttgaatatcctcattgtccaagtcacgacggtgaaagtaacggcgttcacagggaaagcacgaatcaaagttggcgccaaacccttgaacaaacaagaaatgcctccagattggacagttttcctgaaacagtcgtaagagctggtgtactgtttggatgttatgccatccacctgcattctggatttgattaagtcgacggggtatgttatcagccaagatgcaacacctgcaaaaccaccagccattaacattcttccagtagaaactggctcatcattgtcagatctagtcaaaagttcgtaggtgaaaaaatatgcagaatatgatggtacttcccttcctatggtcaaccccagtcctttgaaaattcctttcagtccttcagtggcgaatattttacacagacattcaatcggacctttgccaacattattagaaacctgtaatctggatttggccagttcgatgggactacagatgaagctttgaaacaatccagccgctccaccggctatagcatgacttttcaacgaatctggattgctcaaaatcctctgcgtatttccataaacaccaaatactatggcattaattccagccactcctaacagaggactcgttactccacggtaaatacctttaataccttctttcgctaatagagatcggaggcaatctatcgtgccagaatatctaggattctttgtatcctgagtttgtagaaggaccttggcagtgtcgagaggatggcctaccgtcactccggccattcctccaacacaacctgcaaaaaaatcaagagacatgacctgggctctctatgtgatagacgtccacaaaaacggtaagtttccagggagtcgaggaaaatctttctttcaactgacagtcgtaaattttttgtgttttgctaagtttgtatattgaatccatgtactatctcaactgagtctttcatagttcaactttcgaagaatcggtgtgatgttttcttgaataaccatccatctgatgttgctcaacaatcaactgacacaacatattggatgtgttgaataataatgtattcacacacacaaactttcaggctc

SEQ ID NO: 247 - DNA, 1160 bp, Leptinotarsa decemlineata
  Annotation=Zinc finger protein 470; Tribolium gene name from OrthoDB database=TC006630; Blast E-value Tribolium Gene vs. Leptinotarsa Unigene=8E-41
aaacaagaaatattatgcagtgtatgtagcacaaacttttcaacaaaaaaattagtttgaagaacatcaaagaaccaatgttagctgtaaaataaaacagttcaattgtaatgactgccataaagcatttttttcgaaattcagactgaattcgcatatgagaactcatacaaaagaaacaccatatgaatgcaaagactgtcttaggaagtttcgccaagcttctaatcttaagcggcacattgatattattcataaaggattgaaaccattcaagtgtgaggtttgtgggaaagaatttgctaccctcctgagaataaccgagcacgcgagaattcacacaggaggacgtccacacatctgcagctattgtggagaaagtttcaagaaatactccacccgttctgcccatgaattgcgccacaaagtaaaaaatggtgaaattccaaagagcgacaagattcccaaaaggtacccccgcaaacaaccttcggacccagaagagttgaaatgcaacatttgcaagaaaatattttcttccaagcaagcggtggttgtccataagcagatacacctaggcgaaaaatctttcttgtgtacagtgtgcggaaagggcttcatgcgcaagagccatctggatgtacatctgagaatccacaccggggagagaccattcgagtgcggagagtgtggaaaacgcttcagacaagccacatgtttccggaaccatcttctgatacacaaaggccaaaagtctttcaagtgtgatgtgtgtgaaagaactttcgtgcagatcggacatttgcaaagtcatctcaaaactcacacgggcgaaaaaccctacaggtgtacgttttgcggaaaggagtttgcgcagaatggaaatttgaaagcacacactagaactcatacagaagagcggccttacaggtgtacagtttgctcttcaggctttcatgacttgcctggcctcaagaaacatttgaagagccacaaggtgaaagttgaggacatgtcacataatttacaggttataaaaatgatacgtagtgattgattttcgtgtgagtgaccagggctttttcttttttgttaaagaggttaaatctgttgcaagaattttttgtaacaatataaatttagatttatatgtctattca

SEQ ID NO: 248 - DNA, 822 bp, Leptinotarsa decemlineata
  Annotation=RNA-splicing endonuclease subunit Sen2; Tribolium gene name from OrthoDB database=TC005868; Blast E-value Tribolium Gene vs. Leptinotarsa Unigene=6E-67
aatagtccccaccaaattttatacctggcttcactacccagtttttagctctaaaatggaagtaaacaatataattttgtttaaaatgaggatctgcttccgaaaataatttccaacattcttcagaacttaaaatatttttgccattgaaaatattcaagcacttcacagtttctgacagaaagaaagactcctctagactgagccaaactgtttctttcagtcctgacctatcgatttggtactctggcctcaaatttgtgaaataatcttcattatcgtcttcagagtcaggaacaactataattttcctgatatctttactggaagtctgttcactccaagcttttctttttttatattgcctatttctcaatatttcagtccttttgtcaccaaactgagggtagtttcgtgaaagatttgcttttccaaaataccccattgaaataatttttttcatgtcctctttgtcggtaatacaaactgaaaatccattgaaaaaaccattaattctgtgaactgtaccatccttcttcaaaataactgggagaggtaggtttttggaaagtttgcaacatttcttgggtctgggctccgtgagttccatttttgaacttggcggtacaaacctctcgtgaccaactgaaaaagatctgctgtccttttcctaccttaaagaaaattatttatttggcacattaagaaacgaatgaagtattgttgaggattttcactacatttacctaatttttcattaattttgttaaattcttacaaaacatttgtttctatttgtaaaaataggcgtgttttgaattc

SEQ ID NO: 249 - DNA, 1294 bp, Leptinotarsa decemlineata
  Annotation=SRR1-like protein; Tribolium gene name from OrthoDB database=TC005128; Blast E-value Tribolium Gene vs. Leptinotarsa Unigene=4E-114
ctcaaaatataatcaataaaactatgttacaagtaagtttgtagtactaacacttttagaactaagatgaaattttcatttaggatcatggggaagtttaaatcctaccatctttgcagtttcatcaacacttctttctcctttcccgtgatattcattatgaatttgttcttctaatcgggagcttttcaaataacacaaataggtttttgctacaaattccatttcttctctagccttacatagttgttgatctgtagttttgtatttttgaaattgttccaatatgtactgaagtgccaagttgtttttcaaactgccttcaggtaagctttgacgtagttcggaaattatctgcctgagcacatttatttttcctgccattgcttcaaaattttgtgaaaacaaatttaaactggagatttgctgtcgttctttgtaataaattctatatcctcgatatactttggttcagagtttattttccataaatcctgagaaacaacattcagttttggaaatacatgaatggcaagatcattgaatatatcgtggtatttgaaattattgataatgggatactctaatacataaggtaggattttagaaatatacccagcactttgctctagagtccttctagagcaattaccaacaattttattgaaactgttagcgataattatgcaagaactcaagttatggctccaattaacccaaagcaaattattagtcaattgtttaggacagtgaggtagaaaaaacaacactttattttcaccaagggtcttatgtttaccctccaagttttctttcaacactgtgacattgaaataacccaataattcaatatcattttttgtaaatatcggatcatatgcagaaatagttacatcaaaaagtgttttcaaacaaagtatgaaagcaaattgataccttgatgtaacacactcaccaattctacctaggccaagacaaactatctcggctattgctgaatcattcaaaatgaaaagtccctctttcaaagatgtacatacagatttgaaaagatccgatgataatacttctgacttagcttcacagattttcttgaggaaatattccttgtccaatgataaacttaatgaagtattcgtcttgatatcacatttagtctgagtgatccgtccagttctatttttagaatttctgcttttatatgaaactttcaggaagccgtcaacatcaacatccatttatactcactaaatggtatgtatcccttttttattcaaaaggcaacacaacactc

SEQ ID NO: 250 - DNA, 2333 bp, Leptinotarsa decemlineata
  Annotation=Probable uridine-cytidine kinase; Tribolium gene name from OrthoDB database=TC000160; Blast E-value Tribolium Gene vs. Leptinotarsa Unigene=3E-126
gacagtagaaagttgtctttttactgtggtagaagtactttttactctggtactgctttaaggtatatgttgttgagtcctggtgattttagaatagaatcacagcttactagtaagtaagctgtgatagaatcaccgaaccacatctctgatctctgcttactttaggaacgtgtcttaaagctcattttttaggttaagatattcgcaaatcttgcttatttttattcagttttattgattttaaaaatgagtgaagtacaattcgatagtgttcccaaaatgaattatgccgaaggtaaaaaaccgtttttgataggtgtttcaggagggacagctagtggcaagagcaccgtttgtaaaaggattatggagaagttgggacaagtagatgtggaccagaaacaaaggcaggtggtatgtatatcccaggacagcttttacagagagttgactccttctgaaatcactaaagctgaaaagggacagttcaactttgatcatcctggtgctttcaacgaaaccttgatgtatgagactttaacagatatacttgcgggtaaaatggttcagattcctacctatgactataaaaaccatgctttgcggaaagatgaaatactcacaatttatcctgccgatgttgttctattcgaaggcatattggttttctactttccggaagttcgaaaattgtttcatatgaaattgtttgtcgatactgcttcagatacgagacttgccagaagagttccacgtgatataattgaaagaggacgggatttggatcaagttttgaaccagtatatgaactttgtgaaaccagcttttgatgaattttgttcaccaaccaaaaaatttgcagatgtcattatacccagaggagctgataaccacgtcgcaattgatctgattgtacaacacatccgagatattttaaacgataggaggagttcggaagaacggcagatcagccctccaaaaatacaccaacatcatacttctcagggttccccggccaggcctcccagaaatgttaatgctgaagccttgtttgaaagaaggcattagaagagaagatgctagagaatgtaaatgtaatttattcgacatttgttgaaataagagagagggaatttaggtatttttttcaggagcacttttttgagaaagtcaatacagggagattgacttgaataaaggtctggtagttctaaattttcgacatgtcgtctaggatgattgaacgtgtttaaaaaccgaaaaaatttggaactttctccatactgcttatatctaatttttttttatatctttttcctaatatcaactttattcaccatacctctggtcggtttgtcatcttctatgaatacatcttccaaaaaatgtatcaaagcatatgataacgcctgtgagacagatatgtaagacaaaaaactaatacgattccacttgagaaacgtgttgtttcattttatatagttggcaataaaattattgaacttttctttatcacttgcgaaaattaaaaatttttggcttggtagttgtctaagcaaattgtttctctcttaatgagtcacttgccaatgaaactagataatatttacaaacgaattctctcaatgtaagcattgattcattctattggcatacagtttacaatatggaaacatttcaggataattcgattccaagaacttgtcgtttccagtttccatatatttcattgtccagccaaacatttctcctgtcaactagcaggtgttttctttcaactccaaactatctcgatttttttatggtaaagttctttaacattgttccagagtgacatatgtcaaactcgtaggtcctatccccatagttcaacaggagataaactgaattcttatttccctttctccatgaaatcaaccaatgttgaacctcttacaagtgtctagtttgttttttgttgctttgccttaacaagcaataatttagatgcataagactcatttcaaatatgtgggttctaggagtagctttcctgcatgtgatttgacattaagagtaatggaatgtataaatataataatgagttatataaatcagggacacttctgtctttggatcgtctaagccgagataataataatataaaattttataatccacttgagagtctttcagaaagagaataataaaggccccttattcacgccgtttccaggccgggacagacaggggactgtatatgtgggaaaaaaatcaaagggtctccgtagcaggaggtgacttgaataaaaaaaaatatatcttgtttttataatcgaaaaaatttaaca

SEQ ID NO: 251 - DNA, 1656 bp, Leptinotarsa decemlineata
  Annotation=Cationic amino acid transporter; Tribolium gene name from OrthoDB database=TC000583; Blast E-value Tribolium Gene vs. Leptinotarsa Unigene=5E-137
gagtagtacattggataattgaaaacaatttacttgttatttgcttaaggacgataaaatttcggctgctgtcttatcgggaattgaaagagatactcgtatctacctctagtgatagaaatcggagcaaagtttcttttcgagacatgctgccgtgaagcaagtgtgtagattattgataaaatgtcagagaccaaaaatccagaaaatgggggtaaagtccagctcaagcgagaactgggcctattctccgccgtgaattatatattagccgtgatgattggctcaggaatttttgtatcaccagcttcagccttgaagtatgccggatctgtaggaatgtgccttgtgacgtggatagcatgcggaatgatatctctactaggggccttggcttactccgaactgggaactctggtaccacgatcgggatcggagtacgcttattttgtcgattccttcagcccactgcataggttttggggccctctacctgccttcatttactcgtggattatgactgtagcgatacgaccagcagaaatcgctgtgctcttgctcactttctcacagtatctttgtcagccaatcctcgacttcttttgtatgagcaaccaagaagaaaaccagaaagtgatcactgctattgccttagttgctttgggtgtcactacttacatcaacgtcagcagtgtgaagctgtatgtcagaattcagaatatatttggttctttcaaagtgatagcttgtttgatagtaatatgtggaggaatctacgaaattttcagaggaaacaccgacaatttgacgaaaggtttcgcgggaaccagtacttcgcccaaagactttgctttagctttctacagcggcctttgggcatacgatggatggtcatctgtgacagctataactgaagagttgaaacggcccgaagtcaatatcccaagaagtatatttatagccgttcccatggtgactattttgtatgttttcatgaacatgtcctacatgacagtgttgacccccaacgagatgataaccgcacaggccgtagcagtaacattcggagagcggatattcgggtcattttcagcgatcatcccgctaggcgtagccctcagtacgttcggatgcgctcttagtcttcagttcggagtcacaaggttgtgttacgtttctggacaagacggtttcatgttggaaagcctgtcttacgtgcacttcaaaaaactcacccctctaccggccgttctgttgcaaggcatgctcgctttcctttttatttccactggagaagtgctggagctgattgagtttgcgagttttttgatatggttcttttacggagtggcgatgatatccttattggtgatgaggaagacgatgaaagatgctaagcggccgtataaagtgccgttggtagtgcctatttttatattcgtagtagctttgtacctgagtgttattccaattgttttggacccgactcctaagtatctgctgcccttgggattcatgctgataggcgtagcaatttattcatggttcgtttactacaatcacaggccgaaaactatcatggaatcaatcactcgctgtgttcagcttttgtttagagttgttccaccagaatctgattaaatttttacaattcag

SEQ ID NO: 252 - DNA, 1675 bp, Leptinotarsa decemlineata
  Annotation=SS18-like protein 1 (SYT homolog 1).; Tribolium gene name from OrthoDB database=TC004108; Blast E-value Tribolium Gene vs. Leptinotarsa Unigene=4E-18
atccagaagcgacatttttatttcttacgaaaatcatgaaattcaaaatacataaaaattacaaagcaaaagtacactgaactaaatatcatcgaatacctcatttgttcatgcccaggcttcactgcggagctggttgtggagggtagttgtatccatattgtccttgaggtggaggtggacccggagggccttggttcggaggtggtctatattgatacgcttgaccttgttgtggatactgtggctgagggggataagaattaggctgtggggggtatacgtagccgcccggaggtccccctggacctggcggatacccttgattcggaggggagttgtaacttgcatttggattcgatggctgggagtttggaggataagggggttgataagcctgcgaagtcactggagcgggcgcattaggtgcagatgttacagcaggactgaagctattagttggagtgtttgagaatggtggaggttgagggttgttggtcgaataattctgaggagccccactggattggtttggataggacggctgagcaggctgggattgctgtggtggataattttgctgggaaggaggatagttttgaggaggggcactgttggcataaggagcgccgtttggagggtattgggttggtggattttgagaggagcctcctgggggttggtaaggtcctggggctgtgttgggctgagtgggagtcccattggaagatgacgtgacataacctggttgttggtaagcattatgaccaccactggctgctggtggttgtccgtaagtcccttgaggtgcattagatgcatatggtggttgacttgggggagggtactgacccccttgaggatatccaggtgcttgaggctgatagtgaccagggtactgtccttgggagtaacctctctgaggatactgatgaggaccaggaaggccaggtctctgcggaacttgctgctgtctgtatggtcctccaggacctggaggttgttgctgatgattgaaattattcatattatgctgttggtctgttgttggtggtgtgtgattaggctggggaggtccaccccctggacctggaggttgaatcataggtaagagagagtttacgttttgtgcagagtcagctactgtagccagaaaaaccaaatttctgtgaagggttgtctgtaactgcataacttcttgggatttacctttgctctgatagtcctgtatagtttgaataagactcccgttttcgtccaatagcctctgaatttgtttaggatctggaggtggcctagggccacgttgaggagcaaatgcagcagacattgtacttcctagtatgcactactaaaccaccagagtgaaacactctaatgttatttcatcacagctaacgatacagtgactgcaaactatgaaagaaaatgcacaaattttttcatcgggtgattggataatcaattttcaccaaggaaaaaatggaaaatacaagcaagcagcttcaacaactctagaagaaagaatgcactatcgtacaaaaaattgacttattctattagttgaaaaccagtttctcaatataactactaagagtagcttttcaagttttcaataaattcaactataattcagccagccatacgccgatccatcaaattgtcacttgtcagt

SEQ ID NO: 253 - DNA, 2548 bp, Leptinotarsa decemlineata
  Annotation=Exocyst complex component 6; Tribolium gene name from OrthoDB database=TC011021; Blast E-value Tribolium Gene vs. Leptinotarsa Unigene=0
agatattctgtgattcaggttcaggttaggataacaaatggaagtaggagttatttgtgattgaaattggatatgagactttttgctgatcactacttttttcaatatgtttagtacgctttgaaccttcaattataaaaaaatggataagactactttaccagtaattgattctcaatatgatttgtatctacaagaaattgaaggcatagatgattattggggaccgactttcagaacaatatttgataatgatgaacatgtggagttcaggaaaaagctggaagatagaatcaaacatcatgataaagatatagaaagactttgcaatgtttactaccaaggtttcattgaatctgtaaaagagttgctggaagtcagatctcaggctaagaaactgaatagccaagtaataggcttggataaacaggtacaccttgcagctgaaggaataacaaaatctggtacagatttaatacaagctaggaaagtgcagagtaatattgcagaagttattgctcagctaaatttatgtttgcctgtttttactacttattccaaattacagaaacaaatatcagagaaacgatactatccagcactgaaaactctagaagaattagaacatttgcatttgccccatgtagcaaattaccgattctcaaaacagttgcaagtaattataccaaagtatagggaaaaaattgaagttgcatctatgtcggacctgaaagacttcttggaaaatatcagaaaattctctccaaaaataggggaagtagcaatgagacatacacacgagcagctcgccagtgatccaaccgtagttggaagaaaaaagaagagaaatgctccccagccacctgggaatttttctgaagaggaccgtagtgctcaagaactcatagacttttctccaatctacagaggattacatattgcccatgttctcggaagatcttccacatttgaaacctattatagagcagaaagggccaaacaagcaaggcttgttctacagccccctacaaatatgcatgaatctgaggacagttacaggacatatattcaagcagttctgggctttttcattttggaggatcatgtcctgaacactggtagaggactgataactagagtttttttggatgatatgtggaacatggcactctctaaaattgttacaactctacagacccattcggcatattgtactgatgctaccttaatcctcaaaataaaagacttgatcatgctgttctgtaccacattgaggaattatggatattctgttaaaccattatgggagctcgttagagaattgcgtgaccactacacagaagtcttgatgcaaagatgggtgcaagttttcagaaaaattttatccgaagaagattttcaacctatacaggttcatcatcaagatcagttgaacgaaatactcttgtcatttccatgggaaggagacttacctgatgatataacttatccatatagttttcctttttctagtatggtaccaaaagtataccgagaagtcaaagaattcatctatgcctgtgtcaaattttcagaggacctcaatttgagtcaagtggaggtggatgaaatgataagaaaatcaatgaatttacttctcaccagaactttcaatggctgtctctcatccacttttcggagcccacatgttaatcttcaggaaataattcaaattatagtagatactggttatctggaagaagccaacgtgtatcttgatcagtttatttctaatataactggagaagaatctcggggagtgacatcaggtttgggtcatggtcagacagctttattttcggtatctagagaagaggctgtacgacaaatttgtgaaaaattgaggcaaaaactcgacgagttcttagagctagaaaattatgactggttattggtggaaccgaagggacacgcttccagctacatttctgacactatagcattcctgcaaacaacatttcaaagtttcactaatattccacttgaagcggcacaaattgcttgtaaatcagcttgcgaacacatcgcaaattctttactggccctactactgaatgaagatataaaacagatttctatgggtgccttaaatcaactgaatttggatttgttacaatgtgaacaatttgccgcctctgatcctgtcaaaggtttgcaagaagattctttattatcgtattttgaaacactcagagaaattttggatttgtttatttcatgggactggcctacttacttccacgactatgcacaagaaactaataaatataagaaggttaatccggatgtagctataatactactagaaaagctgaaggaaggtgacaagaaaacgatgtttacagttttgaagaaaagtgaaagagataagaaaaagcttcttgaaactgttttaaagcaattaaggcaattggctcagttgccgacaggaaagtaattttctaccttgttaagaaatatattattgttgtgtaacattatgttcattaataaatatatatattaaaag

SEQ ID NO: 254 - DNA, 1783 bp, Leptinotarsa decemlineata
  Annotation=Transcriptional adapter 2B; Tribolium gene name from OrthoDB database=TC009145; Blast E-value Tribolium Gene vs. Leptinotarsa Unigene=2E-159
ggaacattccaacccccactattccaacaataatcaatacatatcctaataatttcaattgaacagcaccatatttcaccataaattactctccacccataagcagcagttacataattttttacccatcagcgttagaagaaaaagtctccaaaaaaagtttaatatccaaatcattcgacgcgctaaaaattgtaaatacacatctcttgagactccatatctcccaatcaactgattaagcctcaaaaggctgacccgtaattaaaaccattttagccaaaaacatcttgaaaatatctcattaccaaattctgacagtaccgccaaggatttacactgacggtaacaattcacacagaaagtcactttccaaacatcaaacaaccgaaacacctggtaaccaaccgctgtagctcaaatattgggtgattgcttctttgatgttcgtatccggtgtgtcggattcggaggaggatgtccggtgtttcccgggagatagcaggttttcctggatgattaatgccttcaaggtgttatagtggatgggctgaatgttcaaatttgcacaaagttgtatttcgttttcagacagcaaatttcccgatgggaaatgcttcaaaggcaccggttcgagcggtgcactatccgagttcgagttgttgctggagaagcagttgctggtgtcgcatccgtcgcttggaggaggccacgtgaacctttcttcggtgaaacttttgtcggctctttcgtttttttcgtttttttggggaaactccagcgttgcatagccactgagatttattctgcctcatctgctgctgcctctcgtaggcagcgtgctgctcataatggataatttcctcctgggtagtcaagccgagaccgcggtacttgagcagttctgaaagcctatggcgcaattctctctctcgctcgatgctagcaatcagtctctcgtgctctcctgatgagagatactgggcaaaaactctcattttctctcgaaggtccctctgctccttcgaaagcgtctgtttttgatgcagttcctttctgttggcaaaatatttagctaccagttgataatctctgacaatccttttccttctggccctctcacgcaatcgtcttgcgtacatgtccaccatcgctagcttgagggccacctccatctcgctgtcttcctccgggtccaactgtagcttggaaaccaactgctcggcttccatgttgtactccctctcataatcatccctgtggggtttgtaaccaagcaaccgggcctcctctagagtgacatcaagtggtggcaatctcgctgtaacagtaggtgacagaggaccttcgtcttcaggcacgtgatctaccaacacttgcctatgattcgcaagctgtgcccaagtcgcggttcctatatttccttctaaatagcgtgctatatactcttctttaacctcttcaggtgtcctagtttcgacgtgttggctaacgagttcccaatttccaaatccgtacaactctacggcgtccaatagctgcagctgttctttgccagtccaagcacccttacccccgaagatgctcactgcgcagtggtcgacaaatttgtaggagtggtcattacggtgggggccaatttctgctccagcagagaaacactgaaggcagatttcaaaatcaggacatacgcagcattgtattcggacgctgttgatttcttcttggcaataagtacagctaactttggcaaataaatccgccatgacagttgtaggcattt

SEQ ID NO: 255 - DNA, 2319 bp, Leptinotarsa decemlineata
  Annotation=Putative uncharacterized protein; Tribolium gene name from OrthoDB database=TC013595; Blast E-value Tribolium Gene vs. Leptinotarsa Unigene=3E-81
ggacatttgtgtttgtgttgaaaaggtacaatgtatggaagatataattaattcaatttattgggatattgatgagtatgactgtactgaaaaatacaatagtttctaaatgtggttgaaattgtggaaatcatgacccattattggtggatgcattggttttggattaccctatggatttctttgaccatttgcaaatcaattcctgcaaccatacattccagcaccacagatatgccttctgccagcattactgtcgaatcggaccattcagtagaactaccaagaagctcaacaaatccgcccacaacccttatgattcccgttgctccgaaatacacatcggcaccaaaagacactaccgttgtgaaacatgtgaagtcttctttcaaaaagtacgactttcttttcccaaattcaaccagtgaaaataaaactaaggaagtcaaggtcaaagaaactgtgataaatgtcatggaaaacatgacggataatccactacttataaattcgagcttaatagcaataaatcgcaccgataatttaacatacttggaggaggtggagaacctcaaccagagttccgtccagaactctgagcgattaggagtggaagaaaatgatgatgagttgagctccgaaggaaatctctctgcagccggtataaccggaatcaccctaggttgtgtcgttacagtgggtattttatccggcatcagctatttcatttatagaaatcggggattcaacaggccacaagtacttaacgatcgatgcagcaatccggactcaagtggatatatcgatgatgcttcagtaagagacaactccgaagaaatgtacagcttagacaacgattcatttttaaatagtttagaagctatgaccatacaaaactactggacagatactgtcaagcatacaaagctgtagttggaaccccacgtttttattattttcttgtacatattttgtacctaatttaagtattttagaatctgtgatgcatatcaaagtctcgagaatagggccagtactaacattgtcaaaaaattatgttgaatatttgcaacaagatgaccctcattttgagtttttcaagttgaacttttatttcttcaatgaaaaaaacttacttccttctgaaacatttttcaatcgaggttggaattttctaatctacatatttttcagttttgataattttttaactttgacatcattttattgagattcatcttgtaaatactcacaggaaacaataatgaaacttaaatttatatttgactaatgtgctggagttcctttcttttctctatatttttctaaaagattgtacagcatttatgtgatttgttaacatattcttttttcttttgaacgtattgttttagataaagtacaaacctttaattgtttttaacttaggatgtcgtaactgtaaatatgtattattgtgtctctacattaatcttccaaatgtattttagaaattgaatcatacttgtataacccttgaataagattctgtaaatatttatttagaatttatactattagaatttgaaattaggctcgttacttcaaaagggtgaaacatttttttttcaattgaaaatgttacttctaataaacaggagaaattctatttggaagagcctagtttgaaattcctgccacaagggttataaacttatcttcaaaagtagtttgggtgtgaggtaacttctctgttcattacgtgaagaaaatatctcaaattatcgttggaagatgtctcttgagtttagaattttagttcttatagtcatgaatattcactaaggagattattaatatttttacaattatacggaagatgtttctaaaaaatttatttaacaatgactctaattatatatttatatttaattatattcatttgtatttacaacaggtttattgtttttgttttctggagatctttatattttattaattttttttgactcgtatttcttgaaaggctcttgggtgcttattttttatagaaatgtaacgatatcttggaaagttatattgctttttaaagactaatattcttgcatataaagtgttattcgtttattggctttctacattgatttgaggtaatttttttcaacaagttttttctctgatgaacaatgatcaagaaataataccaaccgaaacaaataatagtgtgtaaggaacttgaaattgtgaactagtgcaataccgttatgttgatttttcttttgtaaatagttttataaagtgaaatgacctaaatgtatagaaagaaaatgaataatattt

SEQ ID NO: 256 - DNA, 1678 bp, Leptinotarsa decemlineata
  Annotation=Ras-related GTP-binding protein Rab11; Tribolium gene name from OrthoDB database=TC004925; Blast E-value Tribolium Gene vs. Leptinotarsa Unigene=2E-143
gaagaatctgacgtttcttgtcaaaggggcgtacaaatcatcaacaaaacatcgcgacgccattttgtgtatgtaataaaatcaaaaacagaatcaagatttgtacaaatcatcttcggtatttttcaaaccatattggaagtaatgtttctgtgataaatagggtgtattgaataggacgatattttctttgtgatatgtggtaaagtttctttgtgttgattttttgaggatatagaacttaatttatagaaaaaaaaccatcctcgataaagatgagtacaaaggacgatgaatatgactatttattcaaagtggtccttattggagattctggcgtaggaaaaagtaacttactatcaagatttactagaaatgaattcaatttggagtctaaatccactataggtgttgaatttgcaacaagaagtatacaggtggatggcaaaaccatcaaggcacaaatatgggataccgccggtcaggagaggtaccgcgccatcacggcagcctactatcgaggcgctgtaggcgccctcctagtctacgacatagctaagcatctcacctacgagaacgtcgaacgttggttacgtgaacttcgagatcacgccgatcagaacatcgtcatcatgttggtaggcaacaagtcagacctcaggcatctcagggccgtgctgacggatgaggcgaagggttttgccgaaaggaatggactatcgtttatcgaaacgtctgctttggattccacgaatgtcgatatggctttccagaacatactcactgagatttatagaatcgtctcccaaaaacaaataagagaccctcccgagggtgatactatccgaccacaaaacgtagagcaaatagatgtgaaaccaacaatgaattctgacggtgtacgcaaacagtgttgtcagtaataaccgattgttagcaatactatgcatgttacactaatcatgggatttcagcaggtagcgctgccttgtccaattcacttcagctactgtttccttttcggttcattttatatatcctcaaacctgtttgaatgctgaaattgtgctgtgacagagcggataccattttttgctgtgcacttagtatgctgtcgatttgagtttgtaaattgttcggtactttatatttttaaaatatatatatatagaaatattatataagtaatgaaaggtttattatattcgaatcaggtgcatatttattgttaacttatgtttgttttctgtgtaattccaggtattaaaagtaatataatcaaaagtttcgtttttccttctaacagagttaatgatagattgtaaatgtgctgcagttaatacttgatgaatctttaccggtataataaaaatatataaatatctttgactgttagggagttgaaaatttatctgtgcagaaatctcgacacacgcacaccatcgtttgtctaatgattttgcctcctgtgagatttttagtagttgaattatttcggactcgtagttatatccgtgggaagtgtagataaataaactttctgttatagtatattgttcagctggccattacggttatttcatttggacttctggaacaaatgcaataattgttgtcaaatgtaatataagcttctttataaaaaatattataaatttaatttttaaataaaacttat

SEQ ID NO: 257 - DNA, 3818 bp, Leptinotarsa decemlineata
  Annotation=Frizzled 2; Tribolium gene name from OrthoDB database=TC006527; Blast E-value Tribolium Gene vs. Leptinotarsa Unigene=4E-68
tttttttttttttttttttataaattcgaacagtaaaatataattaaaatcgtatacattttgaagcatacagacaagttacatatagctatcactactatacacgcaattacaaataatatgctgtacaagatttccattaaaaaaatatacacaataatttgagctcagtcatgaataaaatttcattttgtggaaacaaaaaaatatataaaaaataaaaaccttctgaaataaaatttacaaagacaaacgaaatgtgcgaaattcctttttccggtcgttttgatatgttctacactcatatacattcaataaagctataattctcaactgttgctttgatgatttttccgaccacgctggtggggaggtcgttcaaaactccaaagcaacagaagactcatctggatacaaaaaatcacttttttcatcacatccaacaaggacgcctatacattcatatgttattattctatacatccatatgataatttctatcaataaatattacatgtattgcagccgacttcgacaaatatgcctcgttgcgccagtgatatttacaaattgattaaatagacagcagtacaaaaggttatgggggtccacttttatcaacaatgtattataaaaacctatacgctagccagaactacaagaatatattaatatttttacatttatttctacaaaacacacaccacatacaccctcttcgatatttcaatagaatcaccaaaagatggtcccctgtacacgttactatggcacaaatatggctgatttccaattttctcttgcttcaattattctaatgaaatatcaaattcacattcagccgcacgtttaccacaaaagagtactagtcgaagtaaaaactatttacgtatattattcatcacttttggtattcagacacttaatccgcgtctttcgaaaattgggaagggacaattcctatactatttgtgtgtgaggcagtgtcgagacagaatgattgataacgttgcacaacagataataaatcagtggagatttactctggttcaggtatatagaaaacacgtggccaccgataccaaatagtttttataagagttgaactactaaatattcactcaacagttttccaaaaataaaaactgacaggaattttttcgttctaggtaaatgtgtccgggataaatatagtaagactccatggagtctcgaatccaaatatatgcctcacagtaacattcaacaactaggatcgtacctacatcgtgtcttttctactgaacatgaccgagggcctcgacatgagtatgagtcattcccaaatcacaaatttgaaatttacacatcaatttcccaaaaaataataaataaatacacaacaaatccgtaaagcgattccgtctgtacaaaaaccgagtgccgaatgagatgacaccaccagagactagagagctgtgaccatatcgcggggcccccaggcggtcactcaaataggcccgtagttgcttaaggaaggtccagaaccctgaggaggatgactgaccaccataggcgctgccccttctcccgcttgtcatacgtggctcaacgggggttgtttgagcacgtggtgatgcaaatggtgctggctcgccgaggctacactgcccgtgggccccagaagagaggcgctgcccggtccggctactagatattgcggcggaggcggtttgcaagctctgttcttgatgagcgccgcgttggcaccagagaagtccggcctgccaaagagccgcctccacagcctcttccacgagtccaaggtcttcccggaccagatccacactccagaggttataccgacggctagcgccatgaagtacttgagcattaggaccgaatagagcggccgcactttcacggggaggatgtcgctattggggcacgtgcaagctagagatcggagccactcctcgtggaaggtcacttcgtaaaggtgacagcctatgactatggtagcgggaacagtgtacagcacgctgaagatgccgattctaatcatgagcttttccaacttatcggctttggatccggcgccgtcaccgccttgcttcttgatgacgttccttattctgaataaagacacgaatcccgctagcaggaagctagtaccgagtatcaggtagaccacgagagggcccaagacgaaagtcgaaggttatccatgttcatgttccccacgtagcagatcccagaaaccgggtctccatcaacagcaccggacaaaagcacggccagagtttggaaggtggggatcagccaggctgctatgtggaagtactgagcgtagccggcgatggcttcgttgccccacttcaacccgcagccaggaaccaagtcagcgacagcaccacccaccaaatcgacgacgccatcccgaaaaagtacaccaaaaggaaaaccaacgtgcacaggctcggacccgtggatgaatatcggatcattctgtcctcgcaggctacctcctcgtgcccgaatcccacccttatcaagtaccccaccgagactaggaagtagcaggccgaaaggaagacaatgggcctctcagggtatttgaagcgttccgtttcgatgaagaacgtggtgagtgtcattagggtggatgcggcgcatagaccggaccacaacgtaatccaaatactggcgaactccttttcctccgggttgaagtaggtctccttgcacgggaatgcacagtttgcgacgccggcgacgcttctgtttaccatgtgtattgtttctctccccatggcgactagagggcgttgacactggcatttgcactctcttgcgcccttttttccgtctgccaggggattttgacagttttttgaacccttacatggtcggaggggtttggtgcggctcggaggtggtttggctgtagacgaagctttcggttgagcgggctggtccatgcagatggtgtcgccgccttggacagggaatctatcgcactccatcctttcgggccagacgaagccgtactgcgtcatcagaggttcgcagccagctctggctctcctgcacagatccctgcagggcagcaagggctggaagtagtccggtagacaaatcggcacgtacatggagcagaggaagaacttgaggtcgggggagcatttgatttcaaccagtggccaaaactgatgcacttccaatccggcttcttcttgagtgtcgtggttgagctcgttcggcatatgagtcatgttatagcctatgtgcatgcacataggaacggttatgttttcgcatcgcatctctgattggtcgagggacatgtaagacgaactggcggtaaaggtctgcgtctctagagtgaacagtattaaaaccacaagaatgcagcttgtggctttcatggtgtaggccagatcatgcacttggggactgcaatattctcctggaggacgattcttcaatagctacagacggattcaactacgatgacattgttcggacatcccgctgcgccatggcacccttgatttattgatgcctttctcgattttcaaccctttcttctatacgatcgctattttcgtatcctcgctctgctcctccgaagatggatgctccaaactgatgttgaagttaatctgtttatcggtcgaacgacacaatcggtagccgagataagataaccagatcgggataataaacaacaatgtcacaataaacgcattctgtagaccatcgggttttgtaggttaagtcagcaatactctacgacgtatcctacaaagaaactattgtctctccgtccccttact

SEQ ID NO: 258 - DNA, 2202 bp, Leptinotarsa decemlineata
  Annotation=Protein fem-1-like protein B; Tribolium gene name from OrthoDB database=TC008808; Blast E-value Tribolium Gene vs. Leptinotarsa Unigene=0
gagaagaagaagtattttttacgtcagaataaggaaatttcgggaatgtagggacaggaatattttcatcatttgaaaatagctttccaagatactgcgaatagtacgattaataaattaaccagatgctgaacaatgcatgagtcactttcagtaatgaaaaatcgtgtttattacgctgctaaagatggaatggccatagctctgtacactttaataagtgaaatagacaaaatacaagcgaatctcctaataaatgagaaaatatctgaagaagatgggcaggaatatacaccactcatagtagcagctagaaatggacacgaaaaagttgtacaaatacttttgaaaaaatttagccctgatctggaacaagaaggcactgtcaaatttgatggttatgttatagaaggagctagtgcattatggtgtgctgcttgtgcaggaaatctaaatatatgtaaagctcttgtgaaagctggggcagatgtgaatcatgccacgaaaaccaattctactcctctcagagccgcgtgttttgatggaagactggacgtagttaaatacttgacttaccacaaagctgatataaacatagcaaataaatataacaatacatgtctaatgatagcatcgtacaagggacacttagatgtagttagttttttactagaaaacggtgccaatcctaacgaaaaagctctctgcggtgccaccgccagccacttcgcagccgaatgcggatacctcgaagtggtgaaggaactcctcaagtacgacgccaaattctcgaacaacgacgccggcatgacgcccatcaaagctgccgctgaaaggacgaggtcggacgtcgttgaatatctggcgcagaggccggagatcagtcttgaggataggatcgaagcgctcgaactactaggggcatcgtatgcgaacgataaggaaaattatgatctagtcaaggcatataagtatatgcacatgtcgatggaattgaggttcagtgatccagataacccgattaagaaaaaattaattacacctattccggcttacgaaaactgggttgaatgtcagaacgtcgctgagctcgaagccctactaggcaacaataacagcttacacatggaagctttgaccatcagagaacggatcttgggtactcagaatccagaagtgccccatcctattatataccgaggagcagtttttgccgataatgcacgttttgacagatgtttggaattgtggttgcatgccctcaagcttcgacaaagaaactatgtatctgttgtcaaagacctcctcaggtttgcccaggttttctcccagatgttacacgtgggcgttaaggtttcttacaatcacgtgtttgaagtattatcggctgctatagtggaacttgaaagaaacaagatgaaaatggtgaggcctggccctaaagatgatcccgatactgtaatggtaatttacttatctgtagaactcttggacgatattgagagtaacttgacaactactttgtacctgttaactattctaacaaaactattgaagcagtgctccgacgaagaaaagttcaatgtcaaccgaatggtgttcacattgaaccaacttgaggttacgctaagagatgggcaatcgctgttacacctggcatgtaatgcagaaacgcctgtggatgatttccatacaaatgatatatgcaaattcccctgcgcagagacgaccaaacttttgatacagtgcggcgctaacgtcaacgcaatggatgctgacaggaatacacccctccacgtcattgtcaactatcataaggctgtgtctgatttcattacgttacactcgattatcacagatctgactgaaaatggagcccatcttgactgcgtgaataaacgtggagagacgcctctggaatcttcagctacaggtagtgtagcagaaataatactcaaaacacaaatgaaattgagtctgaaatgtatagcagcgaatgctgtcaaacagcatagacttacttatcaaggtcaggtgcctttatctttggagtcctttatagaactccacggtcctggtatcaagaaagcctagtcaaatttagatttttaagtacaatatttttttgataaaccagattgtatattgtgtataaatgcaggagcttctacgtgttcaaatgtttaattaaaacgttttact

SEQ ID NO: 259 - DNA, 2135 bp, Leptinotarsa decemlineata
  Annotation=Coatomer subunit delta (Fragment); Tribolium gene name from OrthoDB database=TC003020; Blast E-value Tribolium Gene vs. Leptinotarsa Unigene=0
ggacttttctgatattttcacacgttaacaacgtcatcgttatcgtatcgtctgtattaattgggtgtaatgtttttagcaaaagttaactaacacttttttcagtcaggttgttttttaaacgtctccattagatatggtgcttatagctgcagcagtctgcacaaaagcagggaaaaccattgtgtctcgacagtttgttgaaatgaccaaatcgcgaattgaaggattactggctgcttttcctaaactcgtacccacaggaacccagcatactttcgttgagacggactcagttcgttatgtctatcaacctcttgaaaggctttacatgttacttataacaacaagagctagtaatattttggaggatctagaaactttacgcttatttgccagagttattccagaatattgtcgatcactagaggaaagtgaaatagccgagaatgcattttcactcatttttgcatttgatgaaatagtagctctaggctatcgagaaagtgtgaatttatctcagatccgtacattcgtcgagatggattcacatgaagagaaggtttatcaagcagtaagacagactcaagaacgagaagccaaaatcaaaatgagagaaaaggcaaaagaattgcagaggcagagaatggaagctaaaaaaggtaccaaatcatcatctactaacagcggaggttttggcaattcaggaagctatacacctacgccattcgtcgtcgatgcttccaatgtttctaatgatgtgaaaccaccttcatacgcagctcctattcaaaaaccaaaaggtatgaagttaggtggaaaaggccgtgatgtggaatctttcgtagatcagctgaaatctgaaggtgagaatgtcatcattccagccaagaacagtatttctcaaccaggatccaaagctccagccatcaaaaccgacattgatgacgttcacttgagattagaagaaaaattagtagttaggttgggccgtgatggaggggttcaacagtttgaagtgttaggacttgcaactttacatattggcgatgagaggtggggaagaattcgtgtgcatcttgaaaatcagaattctcatggagttcagcttcaaacacatcccaatgtggataaggaactcttcaaattacgttctcagataggtttgaaacaaccttcaaaaccgtttccccttcatacagacgttggtgtactcaaatggagattgcaaagtacggaagagaccctggtaccacttctcataaattgttggccctcagaagccggagatggaagttgtgatgttaatatagaatatgaacttgcccacagtaatttagaacttatcgacgtcaatattaccattccgttgccaatcggttgttcccccgtagtcggggaatgtgacggcacatactcgcacgaatccagaagaaaccaacttgtttggaatttgcctgttgtcgactttagcaacaagagcggatctttagagtttagcgctccgaaagctattcctaatgatttctttccgctttctgtggctttcacgtctaaatcttcatacgcaagtatcaaggttaccgaagttactctcatagatgacgattctcctgttaaatattcggtagaaactgtgttgtatcctgataaatatgaaatagtgtaactggttcggtagtttcacactattttgtgtataaaatgtttaacaaatattttaatcaattctgcaatgtttccttttgtaaaaaaaaacatgaaattttgtctttattgttaagaaagattaactgactttatttcagtacactttgtattttgtttaagaatactgctagaaaaaattgaattcttgatattttggaaaatgttaataaacgaattatttgaaaaattattaacataatttgcacagatggacatttacttttatctatattaatatataagatatattttcttgtatggctttagtgggttctatcaattttttctagctttagaaatttatagttttttagattataaatatatatatatacactttagtttcaataaaatataattttgtaattatgtcgattgtaaattattggtgtctttatttcaacagtaatcttcaatataaatcc

SEQ ID NO: 260 - DNA, 2997 bp, Leptinotarsa decemlineata
  Annotation=RING finger protein 126; Tribolium gene name from OrthoDB database=TC011026; Blast E-value Tribolium Gene vs. Leptinotarsa Unigene=2E-112
ttttaactattaatttttttaattgtccattctatacaatttttatatatacaaagtaaataacatgactaatgtaaattcatcagttgtttatcataaaaacacacatcacaaaaaaaattgtattgcaattaaattttcagtacaattaatgtacatccaacttttgttattgagaaaactccactactgtcttcatcagccgttgtaactttgactaagaatctcaaaggaattaaaactaattaatctcaagtgtatttcttcaagaaaaaaatcaatctacccaactttataagagattacaaacgtataactcgtgagcatatttttcagaataattccgctaactaattgataaattacataaactacgactggaattttttaatttttcactaggtgttgagttaggcagatcatagaaggtttgtttagagacgttcacttcagttaagttagatttaaactgtgaaacagataactaaatatcgaaaacatggaaaaattataaaaaacggttcagatacattactaaaaaaatcagtaagtatgtcagaagttttaaaaactttgtaataacgagagctgccaaggtttcattgaaagatgaataatgtaggcaattctgcatattaagtaaaaaattgttgatggaatgaatcgaaacattcactttttccatttgacaacaaagttttttatgagtatttaatttgtgatgctgcagtgatgggtggacaaataaaacaacataatttccgatataaaatcgctagtttccagcagcaactcaatgtgtgtttttatgataagtcaattatattgagaatcacaacatgaatgaaataacagaatacagaaacagacaacttcgaaagttgtggaaacgtcaagaaatgtgccaaataaaactcgatttcaatcacgaacagtgcggttcaaaaaaacaatttcacatataaaatgtttcaccttcacctactctgtcgcagcctcaaatgaaacattttagatgggtaaaaacaattttttcatgaatcggatccgctttaaatacttttaggttatgtcttcaatgtttcacaccaaaaaaaaaattgttccaaagtgcttgagtatcacgttttgcagcttagtttcagatgaaacatttcagatgaagcacaacaaatttacttatttccgagataatccaggggaagaattagagtatagtagatggtgttgcttttctcatccacaggaatgaaaaaatgaaaaacgtccgttaaaggaagaaaactctaaaatatcaatcaatcaatactcttcgagatccacagaagtttcttttaaatacaagcaacaagaaaagatttatctggaacaactactctactttaaggatattggattaggcaaaaccaactttttttgaatacagtacattaaatatctgtgattaaaaaattgatataaattgttcatcagtaatgctacgacaacataaataaatatataagaatatatgtatgaatggatgtttgtgtaatgtaattcagtatccttgagacgtttttccaatactatttctcctatttgcatctaaaaaagacatgtgtggatgatctacaaattttcttaagaatatggtaattttttcttcatttctgtttccgttttccattttcttcacccaccagaaaataaagcaaaacgctattttctaattatcaatcccttcacaaaatcctttttatgaataaaagataagcagtgtcaaaccaagcgcaatttccctttccagaaggatggccgcttttcaacaatactcctcaaaaatttctgtagaatacctcaatttcaaaaatgggaaaaaagtattgccgctttttattcttctcctgaatcgtacatattatttggaataattcaaatatcatttcatgtataattattattaaatgacttcaaagcaagcacaattcaaatatcaaatctaccagttaattattggaatcactctgcgacctcgatcttgttcgagccccttgattatctaaagaacttgaactagaaccgttggaggaattactacttcgagattggaacagtctcagaagattgtagttgctgctacctccacctccagagccagtgtcttggttactatcactagaaagttcgttatttactaggttctgccgacagatggggcaagttccatgcaactccagccatggccttatgcaaggttcatggtaaatgtgcaaacatggcaactgacgaacagactctctcaattggaaatcttcccagcatactgaacattgcagtttcacattcacctgttcctcagttacttcgactatcggtagggcatcgataacttctttagaaacaggtggtggacctgtgctgtccatctggttcaatagctgagtaacaatagcgtccagtccttctcttccccaggcataatcgccgggatgtcccagaaatacctgcatattttgaggggtagcccagttcattcctaaattcacaacaaaatcttgtagtagatgttcaagtggtatttgctgtcttaaattggaggtagccagtcttgtgagagtccttctgccaggacgattcccttctgatctggatcgagttcttcgttcctcaatgaaatccagaggcaatgcagtcattagtgtatccgctacttcagaatcttcccattcaacgtcggccatctcgtcatttccatctggagtctcttgcaactcttcaacgaatccgtccgagcaatggggacatgtgaaattagcagaggcatcttgaaactgtacgttgcacatgtgacagtaaaacttttgtaaggacccatcctctacagctgcttctgccattgtggaatatttgaccttaaaagtcttataactagtaatttaaaaatgaaatttacaaaaacacttcctcagaaaccacattaaccaccatattcttatcacaaatcacaatatcgcc

SEQ ID NO: 261 - DNA, 3462 bp, Leptinotarsa decemlineata
  Annotation=WD repeat-containing protein 47; Tribolium gene name from OrthoDB database=TC001580; Blast E-value Tribolium Gene vs. Leptinotarsa Unigene=0
gaatcaccaacaaatcagagttgggatgggatgcagtggttgttaattctgataacagttgtttttattatgttatgtttgaataatgtttaaaaaattgttcgatatagttgagtttttaatattcttgtgaaagcagtatctgaatctaagaaatcctcccccgcagctctctattttgataaccactgggattcatcatgccgtcggcacggctagcgctccgagaggaggatgtcgtccgattggctctagaattcctccacaacagagaactgaacatctctcaactcagccttgaacgcgaaactggcgtcatcaacggcaattattcagacgacgttctctttctgagacagctcatcctcgacggacaatgggacgacgttttggagttcatccagccactggaagcgctgaaagcattcgacgtgaggaagttcagctacaccatcttgaagcacaaatatatcgagttgctttgcattaagtcggaagcgaatgttcaaggtagtggcatggacaatgctgtggaagaagttgtcaaggtcctcaacgaattggaaaaattttctcctagtaaagaggattactcaactatgtgcttactactcacacttcctcgattatcggaccatctccattacaaagactggaatccaagtaatgcacgagtccagtgttttcgtgaaatttatccattggtggaggagttcctgccaggagatagaaaactcactgacgaaagcgtgaattgtagtgctaaaaatgatagactgattcaactcttaattaaaggcattttgtatgaatcttgtgtaaattattgtcaagccaaagccacaggaactactgaaaaagaatctcaagaaatgagcttcagtaaattattggataatagtgcagggttcagtgattcggacctaagtttactctcttggctccagagtgtgccacctgaaacattttccgtgcctttcgaacagcgtaccctcaatgtagatatggagcgtttggagaggccgagtttagaaacatcttggactgaacacatgttagttactccgattaagccaaaaacatttccccactcagcaatgccgtttacaaggcctcgttcagcagctgatattatgtcaagatctctgatgccagttttggatggttcagcatatggtttagcgcaaggaggatctgcccaatataatggaaatactagagccatggcacttagtactggagatatagttaccaacggaccaatgtcgaggagtagctttgccagtttccatttgacaggtatcaaaaccaacaagtctatgaacacatctgtagacagattatttgaaaatgaaggagaagtatttcttagcaacagctacgcagagtttcaacaactaccttcgatacaagaacagacgactagtacaccgaaggtgcattcaaatacattaccgaatatctcaaaaagccccgatcgtaaagtctcgaatgcctcaacgccggaacataggggtagagatagtccatcttccttgggaacagctagatcttctagaagggattctttgaacgaaaggccaattactcatcaaaacacttcaacagaacccaccctagtatttgaccaaagtttttctggggaactggttaaagagtttcaaaaaactaaacaaaaaatgcaagaggcattggcaatgcgtgaaagagaaagggaggagatgctcaaacaattgaataatgagaacaaatatgcaggagagtgtaaacaaagtctgaacaaaccatacagtgccagctcagtggtagatagaggctcacaaccatcgaagtcaaccatcaatggaaatgggctcgccgacttacacaggggagagaggcctttagaaactaaaacacgaacccatcacgacgggatctacgatgcagttaagccgacaccaacacccaatgtggacttggataacagcgatggaagcggcagtggcagacctaaattcgtggccgttacttctttggaagatgttcaagcagtcaggtgtgcagaatttcatcctggtggtcagttgtatgcagttggttcaaattccaaaactctcagaatatgtgcctacccaaaactcgcggatatcagggaagaccatcagacttaccaacccatggtactcttcaaaagaacaaaacatcataaaggatcgatatattgtttggcttggtccccggtaggcgacttgatggccactggttccaatgataagactgtgaaactgatgaggttcaacacggacacatctaatctggaaggcgaggaaattgaactcaccatgcatgatggcaccataagagatatttgttttcttgaagatacttccaacaaatccagcctgctcatcagtggtggtgctggtgactgtaaaatatatgtcacggattgtgctactggtacaccctttcaagctttgagtggtcatacaggtcatattctatctttgtacacatggggcggcgctatgttcgtgagcggctcgcatgacaagactgttcgtttctgggatctgcgaactagaggctgcgtgaatatggtaactcccatcaccgtacctggaactcggcaaggctcaccagtggctagtctttgtgtggatccatctggaagactgctggtatcgggacacgaggatagttcttgtgtgctgtatgatattagaggcggaaggaatgtgcagtgtttcaaaccacactcttcagatgtcagatctatcagattttctccatctgcgtactatttgctgtcggctggttatgataataaattggttttgacagatttacaaggagatctaactcttcctctgcctagtgttgttgttgcccagcatcaggacaaatgtatatctggtcgttggcatccatcagaattttcgtttctatctacttcggctgataaaacggcgacgctctgggctttacctccaatttaattctcgaattcatgttttgttaatccataagtctgaactaacaaataaaaacagtcactttgcacttgtgcaccttatgttatgttcatctagttcaagtttttgataagtttttgtatgaagtaacattggttaatgtttgcttatgtgagggtataaaactgttataactcagatatttttaatgtatatctcaagtacttgcacaatgttgatgattttctaggtgctgaattggattttttattttatgtgggtgtctaatcgttgttatttattatctttgaaatttaactgcacagaaataactgtaaatatatttattagctacttatatatatttttcaagcctttgtataaaaaatgattaaacaataatgtacccgttatttatgactttatattgtttagtattatgaaaatagttaatactaatattttgtagtccaatatattatctgtttaatttttaataaaacct

SEQ ID NO: 262 - DNA, 1191 bp, Leptinotarsa decemlineata
  Annotation=TM2 domain-containing protein almondex; Tribolium gene name from OrthoDB database=TC030656; Blast E-value Tribolium Gene vs. Leptinotarsa Unigene=3E-19
tttcgttgatgacgtcataataatcatccatatattcgtattttccattatccatttttcgatgaaaataatgaaaaatgatatgtttccacataaatataaggcaagcttgtgtcatcatcctagctattttaataaatcgaagtcaaatggacgataaagaattctcccagcccgaaatgttcgagaacaaaaatgtcactttggaaaaagttgatcgcgagaaaatgactgtgggtgacttgattcttcgatgtccatcgaacaccctgtgtgaagatctgaacgaaccgtgtataaagtgtgaattaagtaataaatgtcgctacggtgccctcgtgaacaccacatgtcgagtagcagcgcaagtaaattgccgaggccccacacagttcgaaaggactttcatctgcaggtattgctatcagaccgatcactgggagcacagctgtaatcttttagcaaattgcaactctgtcgcagctccaagggcactttacatcaccaactgcaccgtgaaagatgatattttatgcctgggcaacagaagattccttaaaaaaattcagtgcaactggacggggggctatcggtgggcagtctccttggctctgagtatatctctaggcggcttcggtgctgatagattttatttagggtattggcaggaaggcattggaaagcttttcagtttcggaggtctgggagtgtggaccatcatagacgtgatcttgatatcgctgcattatttgggacctgccgatgggtctctgtatatttagtaattcaactggtattcatagtaacatttctctttaataaacaccaaatctcagttggactatgttttgtccacgattgataaaaacttgaaaaaatgctatgtgtgttctttatttgtactccagataatattcaaagtgagatgtatacaatatacattttcatataatactcagtatatgcagtgattccaatatagcatatttcttataagtttgtattttattatatacagggttttttagaaggttgcaatgttgtgaaatagaaacaacttcaaataatggactattgaaaaaagaacatgttcataaattctgtggttgaaaatcaataacaaatgaatttattggtcttcaaaatacaacactacacaagttgaaaagacaacaaatatagtatgtttag

SEQ ID NO: 263 - DNA, 1528 bp, Leptinotarsa decemlineata
  Annotation=Protein anon-35F/36A, putative; Tribolium gene name from OrthoDB database=TC012801; Blast E-value Tribolium Gene vs. Leptinotarsa Unigene=3E-51
gttcgtatatttccaataaaatattaagtaggtctttttttctttgatatgtttggtttgaagtattcaacacgttttaccacttatttaaaacaatccaatcatttattgaatctgttttcccacatatcaaaagacacttgccttgttcattctaagatacgttatttcagccacaacatgggcttacccctttgtgatgtgattaaaagactacaagagttagctcctttgaaactagctgaaggttgggacaatgtgggactattggtggaaccaacctccaacacaattataaacactgcgctgcttacaatcgatctcactgaagacgtcgtagaagaagctattgaaaataaagctgggctgattatttcctatcatcctaatatatttaagcctctcaaacgagtcacacagagccactggaaagaacggataatctctaagtgcataagaagtgacatagcagtgttcagcccccacacttcatgggatgcagtggaaaatggagtaaatgactggttagcatctgctttcaatttaagattcagcaagccaattgtggagaactctgatgatccaacaggaaaatctggagttgggagaataataacaatggcggcaccttcacctctgaacaaaataattgaagatgtcaaaaaacatattggcattcctcacctccgagtaggcttggcaaaacatcaggatatggatacaattatttcatcgatagctgtttgtgctggttcaggaggatctgtattaaatggagttaaagcagatttatatctaacaggagaaatgttacatcacgatgtcctagaagcgactcaaaatggaattaatgtcattttgtgcaatcacagtgactcagaaaggggatatctcaagaattttcagcaaaaaatccagtgtcaatcattgaaggtgatcgtttctaaagttgatagggactgccttgtaactgtgtaatttttattaaaacacagcaaaacgtcaatgtattagcttcattttttcctaacggttttgtgacacaataaatcaacaccttattctatatccaactatttttaaatcactaaaatctgtggggcctcaagggcttttccacatcaaataattcaggatcttgaaggaaaataggctctttggaataagttcccatcaaaccagcactctgggcttttacaatttccttttcaaccaactcttgttgtttggaacacagtccggtaatgtgttttccatagattcgaccggtgtagggagattggaactgcgagagcaaccgtacatttttgtagtctgcttgaattttgtgcttgcataagatgcactcccgcttttctctctcgtatggattttccatgtcaaagtctgggacgtctgtggaacatgatcgaattattctcgaagtattgacaacagcttttaaattgaatttacgaattaaagagttcattattttcaataattaatcaaattccaaaattcacaggaaattaaaaggttatattcc

SEQ ID NO: 264 - DNA, 1048 bp, Leptinotarsa decemlineata
  Annotation=Glucosamine-6-phosphate N-acetyltransferase; Tribolium gene name from OrthoDB database=TC009619; Blast E- value Tribolium Gene vs. Leptinotarsa Unigene=2E-1; Blast E- value Tribolium Gene vs. Leptinotarsa Unigene=02
ataatcatttcaaagcaggtgttagcacaacacctttttgggtatcttatctctgctacctgtaagcttttgtaaatattgatgaaaagttaatatgggtaacaattgcattgagccaaagttctctaatactgagcagtcactgtatgacccagagctgcttaagaacttggattgggcttcggtaagccaaagcctaacgcccccgataacaaatgaagaacctggcgagtcctggcttgtggtgaggcccctgaaaatttccgactacgagagaggctacctggaaattctgtcgcaactgactacggtggggaatgtcacgaaacaggatttcgaacgtcagttctggaaaatgcacacgtctggaggctactatgtcactgtcatcgaagatactagggacgggaagataataggatcgtccactctcgtcacagagtttaaattcatccatgactgtgctattaggggtaggctggaagacgtcgtcgtgaacaacgcctatagaggaaaacaactgggaaaactgatagttctgacagtgagccttcttgccaagaaactcggctgctacaagatgtctcttgactgcaaggaccccctcatagcgttctacaagtcgttgggatacaagctagaaccgggcaactccaactcgatgatgattcggtacgaagaagcccccaagccgggcgatccctcctgacaattagccgccaatgctgccaactccaaagctaaactttgagtgtaactaatttcaacagttttgatcgtacggtttaaaatgccgtacctacaaagatttcaataataatggttattttaaggttgtttttttgtgagtacaaataaagttcaaaagatggccatagggtttggaatttgcagcattggtgcttcgggatattctttagattttaagttaaacaaaatgtattatatttaaatatagggatatttatttttttgagtatcacattgttttttccatattatggacctactgttttataataatttactctaaagtggtaataaactg

SEQ ID NO: 265 - DNA, 7050 bp, Leptinotarsa decemlineata
  Annotation=Dynein heavy chain; Tribolium gene name from OrthoDB database=TC000076; Blast E-value Tribolium Gene vs. Leptinotarsa Unigene=6E-83
agatttgaaatacgcaccctagcaacagtatctcgttgcggcatggtttggttctctgaagacgttctatccaccgaaatgatttttgagaactacattctcagtttgaagaacattcctcttgaagaaggtgaagatgatagttttggaaagacttcagagtcgaaagatgacgtactctcacccacacttcaagtgcaagttgatgttgccaatcttcttcaaccttatctggctccagatggtttagtggtgcgttgcttggagtatgccatggaacaagaacatatcatggacttcacaagattgcgtgctctaagttcgttattttcaatgttgaaccaggctataagaaatgttttgcagtacaaccattctcattcagactttcctctgtcaaacgattctttggaaaagtatattccaagatgtttggtttattccgttttatggagtttcgccggtgacgctaagcttaaagtaagatcagagcttggagatttcatcagatcagtgacaactgtgcctttgccgccggacaacaatatgccgataatagattatgaagttaccattgaaggtgattggtcaccatggtcccataaggttccccaaatagaagtggaaacccacaaagtagcttctcctgatattgttgtgcctacgcttgatacagttcgtcacgagtctttactttacacctggttagcggaacataaacctctagttttatgtggtccacctggttctggtaagactatgacattgttttctgctttgagagcacttccagacatggaagtagtgggattgaatttttcatctgcgactacaccagaattattattgaaaacctttgatcattactgtgaatacagaaagacgcccaacggagttgttttggctcctatccagttgggtaaatggttggtgttgttctgtgatgagattaacttaccagatatggacaactacggaactcaaagagtcattatgttcctgcgtcaaatagtcgaacagaaaggtttttatagggcttcagaccaatcttgggtagccttggaacgcatacagtttgtgggagcttgtaatcctccaacggatcctggcagaaaacccttatctcacagatttttgagacacgtccctgttatttatgtggattatccaggagaaacttctttaaagcagatttatggtacttttaccagggccatgttgcgtttggctcctggactaaaaggttatgctgaaccattgacgaacgccatggtagaattttatcttgcatctcaggatagattcactcaagatatgcagcctcactatgtatattcacctcgagaaatgaccagatgggttaggggaatatgtgaggctattaggcccttggataatcttgcagttgaaggtttggttcggctgtgggcacacgaagccttacggctgttccaggacagacttgtcgaagatgtcgagcggcgttggaccaatgaaaacattgatgctgttgcattgaaacattttccttcggcaaattgtgagaaagcattggaaaggcccattctttatagcaactggctttcaaaagattatatgccagtggaaagagagcaacttagggaatatgtcaaggccagattgaaggtgttttacgaagaagagttggatgtgcctctggttttgtttgatgaagtactcgatcacgtccttagaattgatagaatttttaggcaaccccaaggtcatctgcttctgattggtgtctctggtgcaggaaaaacaactctgtccagatttgtagcatggatgaatggtctttccattttccaaatcaaagttcataacaaatatactgcagaagattttgacgaggatttacgatcagttttgagaagaagtggttgtaaagatgaaaagattgccttcattttggatgaatcaaatatgttggactctagctttttagaaaggatgaacacattgctggctaatggtgaagttcctggattgtttgagggagatgaatataccactttgatgactcagtgcaaagaaggtgctcaaagagaaggtttaatgttagattcaaatgatgaactttacaaatggttcactcaacaagtaatgcgtaatttgcatgttgtcttcactatgaatccatcaacggatggactgaaagatagagctgctacatcaccagctctcttcaataggtgtgttttaaattggtttggagattggtctgatggggctttattccaggtggggaaagagtttaccaaccgtctggatttggataaaccacactggaaatgtccagatttctttccggcagcttgtacacttatacctacaactcctaatcacagggaggctgtcataaatgcatgtgtttatgtccatcaaacacttcacaaggcaaacagtcgattagtgaagaggggaagccgtactatggcaatcacacctcgccactatctcgatttcatacatcatttcgtaaaactccataatgagaaacgctcagacctggaagaacaacaacttcatctgaatgttggtttgagtaaaattgcagaaactgttgaacaagtggaggagatgcaaaaaagtttggcagttaaatcccaagagctacaagccaaaaatgaagcagcaaatgcaaaactcaaacagatggtgaaagaccaacaagaagctgaaaagaaaaaagttcagagtcaggaaattcaacaacagctggctgagcaaactgttcatatagaacaaaaacgttctgaagtaatggctgatctggaacaagtagaacctgctgtgattgacgctcaaactgctgttaagtcaatcaaaaaacaacaattggttgaaattcgtaccatgtccaatcctccagcagttgtcaaattggctttagaatccatttgcttgttactcggtgagaatgctagtgactggaaatcaatccgtgctgtgataatgcgtgataacttcatcaacactgttgtcaacaatttcaatactgaagatattagcgacgatgtccgagaaaaaatgaagaaccgctatttaagcaatcctgattataacttcgaaaaggtcaaccatgccagtaatgcctgcggccccttagttaaatgggcttgcgctcagattcagtatgcagatatgttgaagaaggttgaaccactgagagaggaattgaattcccttgaattacaggctgagaccaaccagaaacgtggcgaggaagtgaaaaatcttattagtcaattggagcaaagtatcgcttcttacaaagaggagtacgcacagttgattgcccaagcgcaagctatcaagactgatttagaaaacgttcaggccaaagttgatagatctatagctcttttgaaatcacttgttatagaaagggagagatgggaggcaacgagtgaaacattcaggtctcaaatgtctactatcataggtgacgttcttctttctgccgctttcatagcttatggcggttactttgatcagcattaccgtcagaacttatttaccacctggtcacagcatctgacgttagcatctattcagtatcgagcagatatagcaagaacggaatatttgtccaatcctgacgaaaggctcaggtggcaagccaatgcacttcccaccgatgacttgtgtactgagaatgctataatgctaaagagattcaacagatatccgctgataatagatccatcgggccaggctacagagttcataatgaatgaattcaaagacaagaagatcacaaaaactagttttctggatgactctttcagaaaaaacctgagtctgctttacgtttcggaaatcctctacttgtgcaagatgtcgaaaattacgacgctattcttaatcctgtattgaacagagaactcagaagaaccggaggcagagtgttgatcacgcttggagatcaggatatcgatttatcaccgtcattcgtaattttcttatcaacaagagatccgacagtagagtttcctcccgacatatgctctcgtgtcaccttcgtcaactttaccgtcaccagaagttcattgcagagtcagtgcttgaatcaggtactcaaagcagaaagacctgatatagacgccaaacgttcagatttattgaaattgcaaggcgaattccatttgcgattaaggcagctagaaaagtctttattgcaggctttaaacgacgcgaagggtaagattttggatgacgatagtgtaataactactttagaaaccctcaaacaagaggcagctgaaattggacagaaagttgaggaaactgacaaggttatatccgaaatcgaaactgtttctcaacaatatttgcctttgtcgcaagcatgtagtaacacatactttaccatggacagcctcaatcaagtacatttcctttatcaatattcacttaagatgttcttggatgtgtttggaagtgtacttcataacaacacaaagctggatggagtttcggactatcaggcaagactgaaaattatcacctccgatttgttttcggtggtgtatgaacgggtagcaagaggtatgcttcataatgatcgacttacctttgccatgctactatgtagaattcatttgaaaggagtgccctctgagccgaatttggatcaggagttcagtttcttccttagaggcaaagaaggagtattccataatacaagtggaatttctttggacagtttgaccagtgaacaacaagaagccattattagactttcgttgaggcttcctgtattcaggaagttgcctgaaaagatcaaagaaatgccagaattcagtgcttggttgcaacaaagcactcctgagcaggctgtgcctcaactttggatcgaagagaaacaattgagtgcgataggaacttccatgtatcagcttcttgttattcaagcattcagaccagatcgtgtgattgccgcagctcaacattttgtttctacagtactcggaacagaattcatgtatcaagctgaaaaagaattggatttgtcttcctgtgttgacaaagaaatcagatcaaatgtacctgctctgctctgttcagttcctgggtttgatgcttctagccgagttgatgatttagcagcagaactcaacaagcaaatatcgagtattgcaattggttcagctgaaggattcaaccaggctgagagggcgatcaatatggcatgtaaaactggaaggtgggtaatgctgaagaatgtccatttggctcctcagtggttagtgcagcttgaaaagaaacttcactcacttcaacctcatgccagcttcaggttattcttaacaatggaaatcaatccgaaactccctgtcaatcttctcagagctggaagaatatttgtttttgaaccaccaccgggtattagagctaaccttctcaggacattcagtacggttccagccagcagaatgatgaaggctcctagtgaaagggccagactatatttccttctagcttggttccacgcaatcgttcaagaaaggttacgttattgtccattaggttgggcaaagtattatgaatttagtgaatcggacttaagagttgcctgtgatactttggatacatggattgatgctactgctatgggaagaactaatttgccacctgagaaagtaccatgggatgctttagtcactctactttcccagtccatatatggcggtaaaattgataatgatttcgaccagaggcttttacattcctttttgaacaaacttttcacaccaagaagctttgaaggagatttcgcgcttgtcgctaacattgataatggtcctggtggtaatcgtcacatcacaatgcccgatggaacgagaagggatcatttcttaaaatggattgaaagtcttgctgatcgtcaaacaccggcttggttgggattgccaaataatgctgaaaaagtgctgctgactactagaggcactgatttaattgggaaactattgaaaatgcagcagttggaagatgacgatgaactggcttactctgtcgacgacaattctcccacagacccggcgcaagtggacggtcgaccgtcttggatgaaaactctgcacaacagtgcttacacttgggtaaaactgttgccagactctttacagacgcttaggagaaccgtggaaaatattaaagatcctttatataggtatttcgagagagaggtgaattcagcatctaaacttctcacagatgttcttcacgatttaaatgatgtattgctcatttgtcaaggagaaaagaaacaaaccaactatcatcgtactatgctaggtgaattggtgagagggatcatacctgtcaactggcaccgttatactataccaaaaggatgtacagttatacaatggattactgatttcagtcagagagttaaacagttgcagcaagtgtccaaacttgtttcaacatctggtgcaaaggaactacagagttttccagtttggttgggaggattattgaatccagaggcatacattacagctacaaggcaatgtgtggcccaagttaatagttggccactagaagagctccatctggatgtaaccataggagattctactgataaatcttctattcccagtgactgctttgctgtcgttggtatcaaactgcaaggagcacagtgtcgaaataaccaactccttttaacatctagcattatgattgatttgcatattactctattccgttgggtaagaatcactggagatgaaaagctcaaagaaagcaagctatcattaccactttacttgaactccacgcgaactgagctgttgtacacagttgagcttaatattgcagcaggtcaagatcctcacagcttttatgaaaggggtgttgcgttacttacttctacttcattgaactaattcatatttatagcctgaatgatattttaagctttaatattgttaatgttttatttattttctatatcaatatgtagctgaattatttttaatttagatgaaataatgaatattattacttgtc

SEQ ID NO: 266 - DNA, 5287 bp, Leptinotarsa decemlineata
  Annotation=DDB1- and CUL4-associated factor 7; Tribolium gene name from OrthoDB database=TC012028; Blast E-value Tribolium Gene vs. Leptinotarsa Unigene=0
gtatttaatctgtaatgtggagaatggcggaatataaagagttataaacttaaacattaatcaaggttaaaagaagccatttccatgtaaatacaggaaccagaatttttggttgtttcaaatctctggggcatataactaatatttatttcaaatatggcccactcaggggttgtgcctgctggaaaacgaaaagaaatttataaatataatgccccatggcccttgtacagcatgaattggtctgtaagacctgataaaagatttcgcttagcgttgggcagttttgttgaagaatataacaataaagtgcaaatagtttctctggatgaagacagtagtgagttcagtcctaaaagtacttttgatcacccgtacccaacaactaaaataatgtggataccagacaataaaggaatgtttcccgacttactggccacaagtggcgattacttgaggatctggagagcaggtgaacctgatacaaggctggaatgtgtactcaataacaacaaaaattctgacttttgtgcacctttaacaagttttgactggaatgaagttgatcccaatttggttggtacctcgtccatagacacaacatgtaccatttggggattggaaacaggacaggtaatgggtagagtaaatctggtcactggtcatgttaaaacgcagcttatagctcacgataaagaagtttatgatatagcattctcacgagctggaggaggaagggacatgtttgcctcagttggtgcagacggatcagtcagaatgtttgacttgagacatttggaacattccacaattatttatgaagatccatcacatactcctttgcttaggttggcgtggaataaacaagatccaaactatttggcaactatagccatggatgcgtgtgaggtaatcattctagatgtgagggttccttgcactccagtagccaggttaaataaccacagagcatgtgtaaatggtattgcttgggctcctcattcaagctgtcacatttgtacagctggtgacgatcaccaagctctaatatgggacatccaacaaatgccaagagcaatagaagacccaatattggcatacacggctgcggaaggagaagtcaaccagattcaatggggtgccacacagccagattggattgcgatctgttataataaatctttggaaatattgagggtataaggaaacatttatgtaattaacttcaatgttcccatgtttctatcgtactagtattttgacaagttttcatcatttagaaatgttagttccttttctttgaaactagtttttttttgttgtgttgggaaaagagttttaggtagaaacacattgcattcagttgtaatatatatatgtaagaataaggttgatgattggaaattgtcaaaatatgttattttatcaaaaacttgtattgaatgccataatttaagactaggataatagttaacattttattttcttttaactgactgaaatgagccaacattcaagtttgtcggttctttcacatattttatgtttgatgttaacaaaatatcagcacgtcttcaggaatgaaggtttcaagttgatttaaatacactttttgctttaatgtaaatattcgctcgaattgatacaaattgacgatcaccttactatcaccatgtttgtgatggatctttctgtcaataatttgagatcttcatcacccgctccttcatgagttaggctttgatttatttaaaaaaatgattaaaaaatctaagttagatgactcgcccttgattaaaagaaaaatttacgttagggttaggttagctctaaaatggatgggtctattagatcgtccactgtaacctataattgtggctcggacttgaaggttctttactaacctggttatgcacactgtctttcgacagtccgggtctgcatatgatgattcagacaacagtgacctgaaagtagacctgggatacaaagtagcctaatgattgttgagcgtactttgaagaatctatgaatgccttgaaatgaaccaatcctgttatattttgtcagtagacagtcaaggccagtgttgccaggaatttagaccagatacaattcaaggctgcttgactggccaagaatattcttattatttaggtatgaagttggtttctggcaatctcaccacacatagaactacagcatagatttctgcttaaaaaacggtcgcaaacgtccttagatgggttaatatctcttatatttcctcctcactaacatttttgaattctagatgcgtttcatcaacatcgttgcttcaccagtagtgataaagctaccgattaagctttggtgttggcgaaacgcgtctagaattgaaaaatgtttgttaaaattgttcaattatcatcatggatagtgttttttactttcattgagtaatgagttattctttttcacagattagttgtaaaatgacgttgattgtttccaaaatctgttatctgtatcataagtgatgattttagtttcgggggaaatcgtttttccatgaagaacaatttatataaacgtatgctttacttggttcattttaaaaaaattagatgtcaaagttacaaatagctttctggccctttgagtttttcatatttttcttggttttaaaaaatgaagtggtttcttgtatatccacgcatcataaccctttaaagcccttcgtgtctctttcatgtttatttacttctataaaaaataaaagcgtggacatttcagttttttttaaatggagtaagttataagttcatacaaactgtttttgaatgttgcaggttcagacttctattatcaaatttgaaggttgtagaagaaaacatgaatgaaattatcaaaaatactaaaaataaccagaatgagtatcattatcattctcaatgattttaatatttcattaattttcattttatttgttttctatattgaacacctttttagacaatataattctggacctgtaacattatgcaagacaggctggccaagtttctttcccaacaactgcccagttcaagaaatcggttataaacaatggaatagaagttatcaattttggatttaattcacgatatttgctgacaatttgtcctatactttggcataataatgttgatacactaaaaaaaaatatttgactctatcttgtcatcagaaaagtagccattgacataaattttcgcagaaaagaaacactctttttcaaaaagtactgagaaggaatttcttactaatgacttgtgtggtaaatgaaaatgtcttagatctctattgttttcttttgtaacatatttcaaatttacatattttgtgagagaaaaatctttctttctatttatatatgcgataatttcaaaagcttttctataaacacaatcaactgataaagaaatttttacaatcttcagtcttcaaaatttatattaattctggcgagtaggtcttaaattattgattttcaactttatatgatgaactggatatcccaaggatggaagtactcaaattaactctcatccaataaaataatagggtgttctaattttttgtaacgatatatcaaatgtttcttttatgtactaacttgtcctttcctctataccttcaaaaatattttgcagcttaactttagtaacatactgtgttgaaaatggtgtgagaaagtttttggtatactaggcatgctatcacagccgatatggaagattttgacattgaaatttacgaaggtgttgtagaaccagttattttttatattctataattcaaactgttgttcaactataattaacaatttgaattattgattatagctgattgacattttaaatgatctattataaaaactacagtattgatcgtcagccccttcataatttaaatcagcacttcaccattcgtagttgagacaaatcctaaaacaacgtatagggtggcaacttgaaataacctattttatcttgcaaacagtagtaaataatctcttaacatttcgaatatatccaaatgttgaataaaaactttttttttatatttacaaattacttttttatgtatcctactcttcaatccttacgatacagttgtctgtagtagtttgtgatatatttataatgttttcttttataccatatattttctatacttaacactcatctgaatctaatttcgttcgaaaaaaaaaattgatttatctcaagaagaccaagttcttttcgatagaaggctcaggggccttcaataagtgataattatcataatattatgttgttatgacatttgaaaagaaaaactccagctgaaatatctgacatgcatagttgtcccttttttgggagagctaataatttcttgattttatatatatgttcgagattgtaacccagtaagaatgtctggaaacgatttttttctgtcttgtttggattatataggatatgttatttatttctttcaagaagatattggattatcaacttgaaaaaggttttgtcagtggaaaatggaagatgtccctgctaatttacagtatctaaaattagttaattatagtttaacattgaaattttattacaacatatcttgaaagttcgattttccaaaacctactttcactggaccattttgtggattgcctgacttttacatgtttccaggttggtggaaaccttttttaaggtatggatgtacgagatgcctgaagacgagtgaaacaacaaccagaaatttttctcggttatttactgttggttactgcgactgtcaccaatcaaccatccaagaacctaggaacaagccacccccaacctggaaacatcaatattgttacttcaacccttgacatacacaagactgatgcgcgcatttccagaagaaaggtattggccagagaaataaactctgacaattctttcattctgaatttgtatactgctatgcagtaatgaactgccgaaagacgtgttggaagatcaaaatgaaggaccacaatccaagttgaacaagatttaatagaatgattttttgtcttgaataaataagatctatttatttttttaacgtggatactgccgggatacagtccattttttacaatggtgaaattcctatttttatattgtttatgtatacttatatgtaccgaaagtggattgtcactgtgtagtattattttatttatttgaggagttctaatagtttttataaaactggacatgtacataataaaaatttt

SEQ ID NO: 267 - DNA, 1659 bp, Leptinotarsa decemlineata
  Annotation=Protein tyrosine phosphatase-like protein ptplad1; Tribolium gene name from OrthoDB database=TC015260; Blast E- value Tribolium Gene vs. Leptinotarsa Unigene=6E-165
agtataaataatatgtttaatttattacaaaacaaaatcgtacggtaacaaacatcgaactaactaaaaacaccagacgtggttcaacccagacttttcatgagtttttaaatatttgttttctgacaatttcgactttttggtggccttatctccgaaagtcaaacataataccaaattttgactacatatttgtgataaggatacaaaaatacacaagaccaatttaaatttttttttaagtagtttagcccaaaaaacgaacatttttccccaagtttctgattgaaaccaaattctaatataaaatctttcaaataataacataatgaataagtctataaaatttatctatggaacacataataactgccactaagaacccagatattggggtaactataatctcttggatttacttttcttgtttttgcttccgagtttctgttgtctgatcttgtgcatatgcctaatcagggtgaacattccggggatcatcacaaaaagcaaataaatcctgaggaatgtggaataatggaatgtgaagttcagggaattcggtaaagagattgaccactttccactctgatctacgaatatcaaatttctaaatagtatcactccttcacaaatgaatccaaccggatatagtattatccaagcgctatacctaatccacgtcagcaatttgttttcttttttgtagagttgggtcatgtagtacggatatctaataatttcaatagcagaccacgagaggaacagataaaacactactggcattttctgtatcctgggctccttctccacatttaaaaataatacgaacagtcttcctacaatctgaacaaagggcaggaacatacctcccttaacatacccgaaaagagggtgcaggatttctagacactgtagaagttgcatgacgcacactactcgaccaacatgttcgtatactactgggaaaaaatcaggtccatcacgcgtgtacttcaaacaaagaacgcacgtaatgtacatgaagcctatgaacatgaagagattatagaaggtgaggtagactttcttgaaatcctcttttctataccccagttcctccttttgcaactggtcatataaatcaggataatctttcaaaacgttgccaactttttcttctagaagatcatcttcagacttccatttatcgaaatcaattttcaaccaggcaggtttttgtggtcttgatgttaaacggggccaaaaacccttctgttctttagttagagttatatcaatcttatggtctgtgatttttacatttttactatttgtgttcaattccgagtgaagatcaataagaaattcatagtttgtcaatccctgtgccccagtgcctttggattggaaatatatctgtttttcttctactgatatgtccggatctttaacatccttcaaatcaatcttcaaaaatatactattttcatcttgtgcccaatagacaaatggactgaaaatagccattcttgtttccttttttcaaaaccgattttatcctctacaattatgtatatgaatttaatgagaccttttttcttgtatcctgcatacgtagaaaacacaaattaagttttatttgacgttcatccttaacctaacagttttaataaaaagtgt

SEQ ID NO: 268 - DNA, 659 bp, Leptinotarsa decemlineata
  Annotation=Mitochondrial ribosomal protein, L48, putative; Tribolium gene name from OrthoDB database=TC007588; Blast E- value Tribolium Gene vs. Leptinotarsa Unigene=8E-61
aggccatgaaaccaaagacacccctttatgacacaataaatattcaattacgaggtacgattatgccatattagagaattaccagaagttcattcacaacattctaaaaaatatggaagtcaacgtagaggactgttgggcaactcctgctcaacatatgcatatatctacttacaagcccaaaagtgaagtcatcaatgcacaatacaaacttaaaatctatgagagaactgttcaaatcactgacgtatcatcgctccagcttccactcgttttaagaacagtggaagccagcttaccagctggagtatctgtagaagtcagacctcacgaagaagctgacgaggaggttcgatatgttccagacaaagaactccattctctgaagcaagagttggacgatttgggaggcccgtccaaaacgaaaagatagaaattgaaatgttctcatttattttaataatagtaaaacaaaaatttgatactattcgattttttcctaggataccctgaaaaatctatagagttaaactgatgaagatatctgttatataaactaataatgcgaataagtgttctcattgtccatttcaaaaccctcccaaaatgtgatacctggttgttgtctgaggtgtgcctcggtatggttgttgttctgt

SEQ ID NO: 269 - DNA, 1234 bp, Leptinotarsa decemlineata
  Annotation=CG6674; Tribolium gene name from OrthoDB database= TC011507; Blast E-value Tribolium Gene vs. Leptinotarsa Unigene= 1E-41
cgtgtctctaatttaagggtgatctcaaaagtcaatgaaaactttttataatagccaaaaacttgcagtaaaatctataagtaaattttattgtggatgttcatcaattctattcaatattgtaatagttgtcaagtttagcattttgatgcaaaacaatgtaatatatgcagtgtggtgatttgtttatatcaaaatgttatatacttaaatcatgtctacagatgaaggcatgaatttgtgttgtattgataatgttcactccccaggataacaccttgccaaagtatttgacattttgtttttattaggtatctaccatacactcactattcaaagaaaatatgtcatcttttcagtattgctaagtaggataaaaatagatacctacctaaccgaatcaaaaaaagtccaaatacttaaaacttgttataataataataaaacttttaatttatgtacacacaatttcaaataggtgacaaatacattcacctacacttatctattcatcttcttcatcttgtaacaagtgatctaatttcaattctttttgattcatgggtttcatgattttgttttttctttccttcttctttttttgtcctactacatactcaggcattacaacttttgaactaataaaactagattttaaagtacctgatgagtctacaaagtcattctgtttatccaataaattgggtttatgaaaaataatcttgtttggaacttcctctaatttctgatcacactccatgtgaattgtttttcttttcctaagttcattcaaaaaattcaatgcagttcttgtattactttcatcagatatatcttcaacatcatctatggaatactttgtccatttgtggggattctttttgaagtctggaatacttcgcatgtagtttttcggaactggattctgtggttttttgaaaatactttctttgcctctgaaatgtttagtgactgatctctgtcttctttccccactattattattgactattttatccacctccatttcatcatttggcagaactaaatcagttttcctgttcttttcaagaacaattagctgatcgaaaacacttttttgacgaagagtgaattcggcattgtctgattttaatgaaaaattattggaaaacgccattagttcattagtatgattcgtcacaatccaagattcaatatttaatgatcgaatgatcccaataatattttagac

SEQ ID NO: 270 - DNA, 2708 bp, Leptinotarsa decemlineata
  Annotation=Syntenin-1; Tribolium gene name from OrthoDB database=TC011815; Blast E-value Tribolium Gene vs. Leptinotarsa Unigene=3E-129
cgagacaaatgacttaaatattccattcttttccaataatgttgtcctaaatcttctctttctaatgtcagtccaatttgtgagttgtgacttgtatctttggaattattgaatttggtaacgtttggatgttattgtttactgtggttgcgttgatatcataggtgataagatatatcattatcgccacagctttgtttttgagagttgtgagtcacacatttttaattgtcatcaaaggttaggtactagaaccaattcaggtgtagagaataattggtagaagaaattaaatagaaaatctacaaaaatgtctctttatccaagcttggaggacatgaaagtggaccagatgtataaggcacagcttggccaaatgcagccacagtctttttccgaaagcactgctagtgctccactatcttccccttatccatccttcaatacaatgccagttccagctaataatagagaactatatcctgctttgggtgaattcatggggctagaactgagtcaagctattattgcagaaaatatgccagaatatttacaagtggcttctttacaacagagggaactgtttttgcctcaaacaacagccactggccttattgctccagtatctggccaatctgtaggcctccatagggcagaggtaactcatggtattcgtgagcttattctttgtaaagacaaggatggaaaagtaggtgttcgcgttaaagcaattaacaaaggaatttttgttagtgttgttgttgagaaatcaccagcagctttagcgggactacgatttggcgatcaaattttgcagataaataatgagaatgttgctggatatactatggataaagttcacgatttattcaagaaaagtccagttaatggtattaaagtgatcgtacgagatagaccatttgaacgtacaattacattgcacaaagatagtgttggttgcattggttttcaattcaagaatggtaaaataactgctattgttaaagactcttctgctgctagaaatggtgtcctcacagatcatcaattgctggaagtagatggtcaaaatgtaattgggttgaaagataaacaaataagcagtatcattgaaaatgccggacaagtggtcactattactgtgatccctagtttcctgtatgaccatatggtgaaaaagatggcgggatcccttctgaaagatttaatggaccattcagttccatctctctaaatatttcatctatttttcatataattatttactctacaataaagtgtgtttcaactgtgtaaaacaaatagtactttattctcacagtaataatacacataattttcatcaatggttatttctgtttcactaagcaacaatacactcttggactattccgtaataataaacttggagacacttaaacttacttctatcaattttttaatagtatctttttcgtttccaattctcacttttaggtattgaaatgtctttttcttgatacatcaaaatagacatgtgttataactttattatataattaacacacacaatatacagtgagtacaatattatttcaaaaactgtcaatgaattcgttttgtttttttatctcttcagtagttacactaaattttattacactgatagttgtactgtctggcaaaccagggttcacttattcatttatttttaatgattagattacaatttgggctgcaaggatcaattatatacctattgaatgatcgtttggaaacgttcatttttaatccaatcagttgcacaaaaatcaaaatatcattttgaattttggaactttttgttacaaattgattgaaaagcatttttaaaatctgattgcacttggtaataagcaggattggtaacctctttatttgcatattcatgttctaatctcagaatgtgcatttgttttcagaaaaattacatttcactctggttaaaatactgttctgcaattcacttcaggtttatttctttatgatcctattcttcaccattggattttatagcagaacactgtcatcatttattaactctattaacaaagtctcagcccgtttcatctttacagtgacagcttatatcttgaaggaatttcaaacatgtgcaaagaaaaagaagtttgccttaatgaatttttttttcataatttatttgctaagaataaaatatatgccccaatagtcatctcagtgtcatagatcagttttcgctgtaatctttagaaaacaaaagccctactggtaaaactgaccctgatatgttaaaaaaagaactgagtttccagtaaatgataaatgcagtgccacctcattttacagagcgggagcaactactggggggttaaggaaatttcctattcctactgcctttacacatttttttgtatttgaacaaagtaacaaaaaatttgatagtggaaacgaaaatcatcttattatatatatattatagtaatgttaattgacttttatatctagattacctatatgttatatatcttatatttataatattgacttcttatagcttctcatttatgtatgccaaaggttttgtgattcatctgtgccagatgtaaaattggttttataaataaatgtatcaaaataaaaaaaaaaaaaaaaaagtaaactaactatacgttagtataacctaacctacgtacgttaccttacgtaag

SEQ ID NO: 271 - DNA, 2485 bp, Leptinotarsa decemlineata
  Annotation=RAB6IP1-like protein; Tribolium gene name from OrthoDB database=TC007707; Blast E-value Tribolium Gene vs. Leptinotarsa Unigene=0
gagtcaatttcaagatggtagaagtggtagagggaagattgagagcaaaataatttagaaagtggttaacaaatgaatctaattccaacagcaccttcccgttaaaattatgtaataaactaaatatcgatttctgagattcaaccaatatttacaccagtgaaataaaaggcaatactacaatgagtaaagtattcgattattttgttatttgtggctttgactacaattctgggttagagccagataaatacgcagaagacaaccttcatgcctctcctttggaaagagcctacaaaggcaaggtattggcctactatccacagaacgaaccatccaacccatttgatgaatccgccgtgtgcatgttttccttgccagctggactcaagtttcgcacacagaaacatcaagtgactcaaacgccttgtttccattcatatgtaataaccagagaggatggtaaacgctgctatggattcagccttgtattttatgaagaagttaagaacagggatatttgtactgccatgcaaacgttacaggctatgtacataaccgaattatcaagtggattgaaaagtcgccccttgccaaattgccaaactcaggggcctcaatctagatccttgcctcgatattttaaattgagtcaaaatccaaacggagcagccttgatgtactatgacatttccaaagataaactgtttgtttctaagagtataggtctgctcagtcgccaaacttatgtgcatgcagcgaaaacatttttagaaaatttatacagatgcgttcccaaacgttcttctactccctacggactcagtctcgaaagttatgtgttcaatattctctacgaggtacaaataccagcccccggtaaaagccttctggttcacttgccaccctcagatcctatgctacctccttcaagtgccataatacaaatgacgtcgcctcccacggagttgccccatctggactattcgttgcggctcatgttcttgtggttgggcgtcgataaagtcgtgcaactgttcacttgtcttttgcttgaatatcaggtcctgcttcgcagcacagattctcagagattgacgatcgttgccgaagggataacttcgttgttgtttccattcagttggccccacgtgtatgtgccaatcttgcctgcttcgctgcatcactttttggatgccccgtaccttttttgatgggtttatatgcctcatcggataatatcaaagtagcttccgaggccaatctctgtttcgtagacctggacaggtgtaaaattcagttaccggaagagatggcagcttttcctcatctggagccattcaccgctgaaatttggtcaactctggataagtacagcgtccacgtgccaaattccgaacaagtcagatgtccccaggaaatagtttcgaggagctgcactttgccggggcgaccgcagaatcggcgaaaactatcgatccacgacaccctggataacgaaaggcccccttcgccccctgggtctgctagaaccgaggcgctccagaggatcgtggatatcgttcgaaggacaggggtcgctatagattcgaatgaaataaaccaacctacggactcctacgtggaggatatgagattcaataactccattcgggagatatttttaaacagatttgtacacattttccactcgtacgagaacttcgtgatattccccaatcaggacaaagaagactggttcaacaatagagactcgatgcagaatttcgacaaggcttcttttttatccgatcagccggaacaagacaggctgtttctgtggcggttcttggagtcgcagatgttcgccactctcatcgacaacaagatactgtccacgtggggggaagtggacagcaacctgctgatattcgacaacagaataaagctgctcagaaaaagatacggtggagagaatctgatgcgttcgctctgctacgaaccgtgcaccagtgcctacgacacacagaaactcatcgacagacgactgtcgtatcccgactttgaatctccctctccaagagaaatcatgaataacagggccgcggtgtcgcgacagttccccttgctgaacaaggaagtgttgaataaaactccggtagtgaacaaagggagtattccaagggccagcgctctcaagaagggactgtccttctcgaaacctcccataggaccgacgagcgataggaacgtcaaaagtaccaacaaccaagacacttcacctgcgctcatcgcgcaggccaattggaagttcgttgagaaacttctcaaagactgcaaagctaaaaccaaaagaatgctccttgcaaaattgggagccgagggagtaactctttcagcagtggtaacataaacgacagttccggtgccgtagaagaaagcactctagtcacttccctttgcgattatctcgagagagtttggtctcacggcctgcagaagaaga

SEQ ID NO: 272 - DNA, 800 bp, Leptinotarsa decemlineata
  Annotation=Putative uncharacterized protein; Tribolium gene name from OrthoDB database=TC012383; Blast E-value Tribolium Gene vs. Leptinotarsa Unigene=5E-21
tcaatgaatcgaagaaacaatatgatgcaattgattgtgcattagaggtactgcagagcattcaacctgtagttcaacagtgtgcgtctctcagaaaactgcagagggatttagaagaaattagctttcagagtgcatcgtcagtacctttggtaccttcggattttaatgctaatgcggccttgttgcaggctgtggctggcttagaaataacatccgctattaattcaactgcctgagtatggtacatgaaaacgttgtttttgataggttaatgtttgtagtgtcacgcagttgtttaaaaggtttgtgaaaaatacagggtgagctaactataagcaacaccatccccaacagagttttaatcaccataaaactgaatgtttactttaattttcgttttaagtaacatattttactgattttcatattttagcaattgaatcaaaattatgaaaaattgtttatacttctgttatttgttgaattgttttatttacacattttctcatagattgtgaattagggttgtgaaaaattgccattcaatttgtagcatgtattttaagcgttatctaaatttaacatcttgataatcataaaaggctgaataatgccatttactgcttccacgtccaaaggaactaagaatatttcattttgatggtattattttatactgagcaattttatatttaacatttttttacaataatcatcagttctacaggttaaaatttcattttttttgatattcaataatgtaaaccgcacacttaaattccgcgaaaggaaaattt

SEQ ID NO: 273 - DNA, 1275 bp, Leptinotarsa decemlineata
  Annotation=Cathepsin L-like proteinase; Tribolium gene name from OrthoDB database=TC013582; Blast E-value Tribolium Gene vs. Leptinotarsa Unigene=2E-66
gatattgaatatagcactcaaaaccaaacttatggtaagaaatatattttgataaattctatttcctcacaaagatttgaagcaataacaggttgataatttttcctccatgtaaactttgaaatatgccttatacaattgaatagttctgggaaagtattgttttctctgttgaactcgatctcaaacatattttatttcagatgaagtcgatcgtgtgtatttttgctattgtagctgttattgaagctgtcagtgatacagattcttgggaaaacttcaagaccactttttccaagtcctatcgaaacatagtggaagaaaaacagcgcttcaatatttttctatcgaatttgttgaggatcgaagaacacaatgagaaatttgaaagaggccagactacctacagaatgggtgtcaacaaattcgcagacctgactcctgaagaattcatggagagaatgaaatattcgaaaaatttcaagccaaagtttgttactcagaaagttaaaatggaatttgatggagacctacctaaagaagtagactggaccaagaaaggagctgttacagatgttaaagaccaaggcgactgtggatcttgttgggctttcagcactacagggtccgtggagggtcaagtcgccataaaaactggacaactatattccctcagtgaacaacaattggtagactgcgctacagactgctcaggttgcgatggggggtatatggacaaagctatggattacatcattgcggctggtggcctcatgatggaaaaagactacccataccaggaatcagacggcatatgtagattcaacaaatcacgtagaattgctcaaatagatgcctacaaagacatagaagctgatgacgaagtcgctctccaaatagctgtagctacaataggacctatttcagttgcgataagtgcatctggaaattttcagttctatgaagcaggtgtattttttgatacaatgtgtggcaacgaggagttcaacctaaaccacggagtacttgccgttggatatggtacagagaatggtaaagacttctggctggtgaagaactcctggggtaccagctggggaatggaaggatacattaagatgtccagaaatcagaataatcaatgtggaattgcaacaaacgcttcttatccagtcacgaagtcataattcgattcaaaaaaatttattatttttccgtttataaatcatgttattctaagaaacaataaaagagtttttttagaaaaacttaacg

SEQ ID NO: 274 - DNA, 1638 bp, Leptinotarsa decemlineata
  Annotation=Bm8 interacting protein 2d-4; Tribolium gene name from OrthoDB database=TC014865; Blast E-value Tribolium Gene vs. Leptinotarsa Unigene=0
gatgggggctgtttatctgatttgtggcctcctcatcttccagttagcgacttcagctgtaggtgagccctcttactacaggcaatacaggatcctgtcagggttgccttcctctaattactactccccacagcaatactcgctctacgcgaacccctacgtccatcatccctacagatactctgatcctgtccgggatgacaaaatttatgttaccgaccaatatggaagaaccacggtgcagtcaggagcgagttatagagcaatgtctttcgtttctacaacatgcactgccaacacatgtggacaaaatgctcaatgccaagttgttcaaggacgtcctgtatgctcttgtttgaggggacattctggtgacccactttcgtactgcaaaagagctgaatgccttgacgacgccgaatgcaggggacaatccacctgcaggaatgggaaatgcattgacccctgtgcaggaacttgcggaccaaatgcactctgcgaagcgagaagaggcattcccgtctgttcctgtcctccagggtacaccggagacgcgataacctcctgcagaagattcgaccctgaggaactttgtcaccctagtccttgcggacaaaatacaaattgcgaggtaagaaatggagttccaacgtgcctgtgcaaacctggttatcatggttcccctctggctggatgtcgccatgaatgtgacagcgatgctgaatgtgggcctacagctgcctgcatagagttcaaatgccaaaatccatgcttgagtcaatgtggaaagaacgctgaatgcgagaccatcagcaatcaccgggccgtttgcaaatgccccaagaactatttcggaaatccctattcatcttgccaacccgaatgttatggagacagtgactgtcccagcttcaaacctgcatgcttttacggcatctgtaagagtccctgtgatggagcctgcggagttggtgcaaactgtgaactacgtggtctcactccagtgtgctcatgtccaagagatatgacaggtgatccgttcgtaagatgcagaccattcgaaccaaaggacttgtgcgaaccaaatccttgtggaagcaacgctcactgcgaaccaggatttgatagatataacaaagagcgaccagtttgtacctgtccattcggatatactggagacccgttgaaggcttgtttcaaaggagaatgtactgatgatagtcaatgtgctgatagtcaagcctgtatcgagtataggtgtcagaatccttgcgtcaatcaatgcggtgtgaatgctaactgcaacgctaggcgccatcttgcggtatgtacctgtccagcaggatataatggagatgctctgatacagtgctaccagaatagaggatcagaagcccccagatccagagctctaacctactgccctacttgttattaggttatttgaaaaggttttaacaaggatacttaacagtatgtttagagatgaaatgtgataaaaatcaaatgtcgagtgtacaggctttttctgaatgagcatattttgattattcgatcagatttttaagtcccgaatagtgttaatatacttattcatcacgtggacatgagaaaactaattaaaaaatatcctaattc

SEQ ID NO: 275 - DNA, 1581 bp, Leptinotarsa decemlineata
  Annotation=Hyaluronan mediated motility receptor, putative; Tribolium gene name from OrthoDB database=TC012383; Blast E- value Tribolium Gene vs. Leptinotarsa Unigene=4E-88
atacaaaattgctttcaagcgtgcggtgcggtagtgaggatttcgttagttaaccgtttgtgcccaattgttcattgtccaattgaataaacgagtttatttatgtgaatatttcgcgtaatcgttggattgaaccgtgttttaattcattaaaaaattcttccaaggccctacgaaaaaaaattgttcaacttttggattcgatttgagattgaaaaggaatgattagatgaacatggaagccgattctccacctgtggaaccagagttatccatcgtaattaccgaggaaactactaccgccggtgaaaaggatggtgtcaccaagcccgtagaagaatgtcaagaagaaaccgaagctgacaataccatacacggtttcaacatatccaatataactgttatcgaaaaagtaacagaagtctgccctgaaaccgtcaaaaaaattccgcaatgtgaaggtagtgatagtggtgtagaggtagtggaaaatttagaaccttgtttgttccaacgtaatcttagttccaatagtggtacctcccaagattttgacaatctcaattgtgcacaatcctgtgattcctcgataataagttgttgttcgaactacgacgaagcttacaatctgctagtacgaaaaaattcgaatcttctcgaagattatagaaggcacgaagatgttacgagtgaaaacggcagtgaaagttcttccatcagcggttccaacttcagggcaaataggcggacctctctgaatagcacaaaaaaaaaagtttcaataccagattcaaaaacgaaacctcccacaaaagatagatctcgatctaaacctcctgtgaatcccaagaatccgaacggcatagttagattaaaatctatcgacaggttacaaaccaaaccaacccagagtacaaaatccaactgccaaagaggtaaaacaactcctacgaatttagatttgctcagttgtcccaaaaaagaaacgataaggccttcatcggctaccacacgcaccccttccaattctcgcaccccttcgactaccccgacagatgatggtaggtggccttctgtgaacagcaaaccagcacctctcatgtcaaggtctttaaagggccagcttgactcccccaaacaaaagatatctcaaatagatgctaaaactatagaaaaatatgcaacacttcctaggcaaaaaaaagagaaaaaatctgaaaatgtcaaagatgtgaaaaagaactctagcagagaaaacactttgcaccgtatggccttaaataaaaaaagctcaagagacaatactccatccaaaatgaccaattccatatttctatctaagaataagcaaaagataaaaatataccacgaatgttgcattcaaacagctctaactatgacggatgttgagaatgctttatcgggagtaatgatcaaccccaagagtccgaaagactccgaaaaatgtgatagagatgttcaagcagatctgatgaccagggaaatggagaaccttcaagagaagttgagccaactaaatgaaaaatcgaatctctacaaaacgaacataaactacagact

SEQ ID NO: 276 - DNA, 2812 bp, Leptinotarsa decemlineata
  Annotation=Pebbled; Tribolium gene name from OrthoDB database= TC009561; Blast E-value Tribolium Gene vs. Leptinotarsa Unigene= 0
ctaaaattgaagtttactcttaaaataaatatactgtacaagtaaaaaaattttcatacaaattatatatcatcttatatacattatcactagatgggaataatcaagttgactaatctgtaatgttatgaaaaccaatctgtagttaaacctccaaatagggaagctgcgctctgcttcatcatactggtggggtcttgggccttttttggagttacttttgatgacttctttggggcttccttggcattcttcaaagattgccccggcatcttttgtgatggtgccgtaactggcagtagaggaaaccaagaagacgttgaaggaatactcaaggctataatagaaggacttagatcttgttctctctgtttttctaaaacccctaaactggccaactgagtggaagaaggtagaagacaaccaaaaataacctgtgattgtattatggcccttttcacgttattctgtagaaatgagtaaaagacatccaaatcaaaagggtctattttacttctaagtttatcacagatgtcttgagaacaactgaccagttcaacattgtctcttgaaatgcaaaacgtagtcatgaatttcatatcgaacaaaaattgtagggcttgtttttgattcagatctttttctgacaatttctcataatgtctaaaaatgacaccaacattatcctgaatgaactgaagatggatttgtttcggtaaagtgtgaggtaatatgtgacacaagtcatcattcatttttgataacacttcattaagagctaaacttggtttcaacggcactcttatttgtgatttgaatactttttcttcagtttgttcttgaatttctatctcatcccatctcgtgaacattttgagcatactcctaggtgaaatatcatccagtatctcacactctttctccgttcttttaacagagtctttcacccaattcagccataaaacatggcttgttttggtaaatatatcacagattttcaaccagtcatctgctgaattattaaatgtacaacacttatggaagtttgggcataattctataatggcttgcaaaaatctcgcacaaattattgattttgcaatcaggtgctccgtttctttgttcaataagttcgacacaaattgtgaaagctctaaggaagtttttgaacactccgactgaagatgattttccaattgaaccttatctactgatttcctcttgaatttgtagtcattcaaaactgttggaaaaatcatttccaaattgaattcttttccatacaaatattgtgacacatcttccaacaactccaaatattttttatccaatgtactacagagttcaactatatttggagaatatcctttggttttcatcgacagtccaacatgtgaattttcagttttactaatatcatttgcatcttcagtccacatataatatcttagatcactctcagatttagttgctttctccatagtattacttatacaaatttgtacctcttgaataataagagcctttttctttgaaatcaaatttcgacatctttcggtgattaaattttggaaaaaaaaataccagatatcgaaatgttcaggtaaatgtgattctttacaaatttgttcccagttgtctggcggttctatcttgagggactcttccctagtcaaatgcaaaccctttacatttggtatgagctctaaagatttcttcagaccaacttcgacacttttctgggttgactctaaccacactttcaaaacattttctacatctcttaataaggtctccgaagagttggaaaatttgcaggttggcctaaactgctttatgatttctggaatatatgtttgcaagggagtaacgggcaattctaattttgaaagtgtagttggtgatgaatcaccaataatttcttgtaactgttgccaaattaaactcttttcaccattctgagcacctatgaaacagtcatgtaaaaggcggacagttgtcattaggcatttgaccatggagctaacctgcattcgaacattagagtatggagtgttcatcacagtattaagggctgttttacgatgttcagtaaaaatactcaacagattattactaatctggttctccaacaacagtaaagcatttaagttctggctggtttcctgtgctgatgtttcaacagattctaatttgtctgtaattttctgaaaaattttagacctcaagacaactaagtttgattttatgtgatttaacactgcaactttatctaaatattcctttttggaaaggcttagcccagtatgtatatgttgggctaataagtaacactcagcagctctcaagttattttcttcatctagtgctatccatatctgttcattaatgaatattgcaagtctaatctgaattataacagttcgttcctcaacttttttatgttccagttgataattagacttgatatcggcatttgcaggactgatgataagttgttcacatgtatttgttattttgtctatactttcaacaatttctttggaaatacttttcatagatttgatagcatctgaggctgctaatacatctttataacggtctccaaccatagacctgagttcatttcgctttctttcaatttctagatccagtaacttttgaatttcaataatttcatcaacgctgcggtcttcaaatagtttatcaatgtctaattccaataaattgttatttctagacattttcaaatattatatttttgaataacctaaaaatgtcaaccttttgatacgtcacaaatttacaggac

SEQ ID NO: 277 - DNA, 3951 bp, Leptinotarsa decemlineata
  Annotation=Hect E3 ubiquitin ligase; Tribolium gene name from OrthoDB database=TC013932; Blast E-value Tribolium Gene vs. Leptinotarsa Unigene=2E-41
aacctgatttcaatatgttttgtattttataattcacttcttataaattttattatatgtgtgaaatttctttatatgtatttttcaacgaagtcaatagtgaaattattttgtaacagtaccgaactacatgcatagaaacaataaagaagatttgaagttctataacattctagaatattttcaccatttttttccctgtcatgaacaagaaatgatattgtcccattataagaactagtaaaagtggagatgttttgttggggtagcaccgttcatggagaactgggactaggaggtattgaagaggaacatattcttactcctagggctttggattggagtttggctggtactgtaatagaagcagccttgggagaaaaccatactctgctgttgactagagatggaaaaatatattcctgtgggaataatgattacggacaacttggtcatgatcagccaagaaagaggccacaacttgtgtctggaatggaggctcattcaataatccatgtggcatgtggctccatgcattcaatggccctcaaccagtggggacaagtttttacctggggatcagattatcatggccaattaggacaaagcttaggagaaaacgttcagcctattccaaaaatggtcagagccttagcaacataccacattattcagatttgctgtgggcaaagacattctgtagctctggccaatactggtgaagttttaacgtggggagcaaatagctttggacaacttggtctgggtacttgttcacaaactgaaattatgccaactgttgtcaaatctcttaatggacttcctgtggcattcattgcttgtggagctaatcatacttttgctgtctcgaaatctggtgctgtgtatggctggggtaagaatagacgggggcaacttggtttgaacgacactgataacaaagtgtttcctacacaacttcgaaccttaagagccatcagggttaggtacatttcttgtggtgaggaattttcaatttttttgacacttgatggtggggttttcacatgtggagctggtatgtttggacagttagggcatggaacaaattttaacgaaattcttcctcgtcaggtcattgaactgatgggctcaactataacccaagtagctagtggacgacagcactctctggctcttgtgccttcgagaggaagagtttacagctttggcattggagggtccggccagttgggtcttcgaaaagctaccagtgcctcaacaccccaggtcgttttaggaccatgggtttctcctagtggaatgtctttagtgcctacgtcaagtgatattaaaaatttggtcatccaaaggatatatgcaggtggagatcactgttttgtttcggttatcaagcaagaaagcaaagtacctccatatgattgtcgtgaaatagatccacaaacacaaattctatcaatatcatatgattacattaaaaatttgttacgaattccttgtgacaatccagttgatcaagatgtgctaacatacctcgagacggtttttaagagtttatcttgtatcaatggttctttcctcttggatgacgacagacattattactgcagtagtaaacatcatggtgttgacattgctgtggcagaagctactttttccctcattggtagaattgagaacaaaagcattacagaattgatatggggctgtatagtagacggtgtcctgccgaatctttcctcctctccgcctgatgtagaaacactccgtatatacctcactctccctctttatcatgagtttaacaatccaaagcagcatcttcggcttcagaaaccatttgcgaatgccgtactcaacctaaaagaacctgctagcaaaatcgttaagggctggttgggtatgatgagttgcgattatcttgagagattagtgattttatttaaaagtattgctagttacattctaaggaaccagaatatacccgaaggaaataccgccttctatgattctagtctcgtagccatgctagatattttagcattattgaacaagatcaatcacacggcccagggcctgaaaatcccatatattactttccatatgaatgatctctccgattacctagatgttcgagtagattacgttaattggctttccgaccagaggacggggcgactattcttatgcaactatccatttgtttttgatgccaaagcaaaaacacagttgttggaagtagaccagtcaattcaaatgcagactgcgatgagttctgctgctcgccaagctttcgtggcaatgcttgttgggtcacaaaattcagttggtatcaatagctttttagtactgaacatttccagagaacacattgttcaggatgcgttgagagaattgagtcaggttaatccacgtgacctcaaaaaacctctgaaggttaaatttcacgacgaagaggctgaagatgccggaggtgtcacaaaagagttctttttattgctcttgagggaaattttggatccaaagtatggtatgttcaaagaatatgaagagacaagagccatttggttttcagaaaatagctttgaagatgatgatgtgtttttccttattggcatgatattgggtttggctatctacaactacaccattattgatgtcccatttcctttagcgctttacaagaaacttctgggcgaagttgtcaatttgaatgacctcggaggtttgtctcctatcttggcaaactcgctacttgctctccttaattatgaaaatgatgactttcaagaagttttcgacttgactttcgagatatctcgcgatgttttcggtgaaattgtaaccgttcctctgaaagaaaatgggaagaacatagcagttaaccaggaaaacaagcaagaatatgttgacctgtacgtaaactatatattccacgaatccgtaaaacagcagtatcaatcattccacactggattcatgaaagtctgtgatggcagagtgttgcagttatttcactctcaagaattgatggctgtagttgtgggaaacgaagattatgactggcatgctttagaggaggcagcggagtataaaaacgggtataaatcatcagatgaacctatacgatggttctgggaagtgattcatgaaatgtcactggcagacaaaaagaaatttctcctgtttttaacaggaagttgtagaataccaatacaaggaatgaagggaatcaagatatatatccaaccaactaatgatgacaaattcttgcccgttgctcatacttgtttcaacttgttggacctccccaggtataaaaccaaagaacgactgaagtacaaacttatgcaagcaatccaacagactgaaggtttttctcttgtataatttcttgtttcttttatattatttcactgtcttttggatttgtcattttacaaatatatttttctgttttttgtctatatcagaacaactgttgttaaatgtactgttatttggctatgaaagtaggtatattacaacgaaatgatcatgaaacatttctgaaaaataaatattcacttcattgaaatatatctatttcatttgtctatcttttttataattttgtgatggcagaacaaaaacgtttgaacagcctataatttcatcctagtattgtatttcagaagtgaatgaagttagtaattttcatttatccaagtggaaattgaagtgatataagtaggacaaataattatttttgatatgtgttcacgaacgccttaatttgtttttcttatttctaaggcatttagagatctacaacacggttgtatggcaaatatagtctgcaaagaaacattagttagatttgacattgatgattcactttgttgaaatatttttatttgttggatttactggttgcgataatttattaaaattttcgaaaatgaaattgta

SEQ ID NO: 278 - DNA, 3316 bp, Leptinotarsa decemlineata
  Annotation=NADH dehydrogenase; Tribolium gene name from OrthoDB database=TC015633; Blast E-value Tribolium Gene vs. Leptinotarsa Unigene=1E-1; Blast E-value Tribolium Gene vs. Leptinotarsa Unigene=05
gactgtcggtgatcagtgacataactcttataataaaatgaattctgtctctttgaaattattttcgttatctaaaacgggctccaaatttctgaggccttccgccttagtccctaatcagaaatacttgtccagctctccaaaagatggttacatttatgtcaatgataaggcaccaagcatggcatttaatgatattactgaccgtgctgcacaaataatgtttttcactgaattgttcagaggatttggggtgactttagctcatattttcaaggaacctgcaacaatcaactatccttttgaaaaaggacctttgagtcctcgattcaggggagaacatgctctgaggcgatacccatctggagaagaacgttgtattgcttgtaaactatgtgaagcaatatgccccgcacaagcaatcacaattgaagcagaagaacgtgcagatggttcaagacgtaccacccgctatgacattgatatgactaaatgcatttattgtggtttttgccaggaagcttgtccagtagatgcgattgtggaaggtcctaattttgagttttctactgagacacacgaagaattgctttacaacaaggaaaagttattgaataatggtgataaatgggagtcagagatagctgcaaatattcatgcagatcacctctatcgttgatttattttaagataatgtaaataactgtctagagaataaaatatatttagaaaggtagtgttgttacaatttgccctttgtaaaatactctgtaaattacaaactatatttctctactaaaactggaacttctggcactttccaacaaaattttgacctccgaatggaaccttgtagaacatccaactcgaaatgaatgtgagatgtgtgcgactgactgtgaagaattcagaaaagaaaaaaacaagatggctgcttggggtatggcgaaaaaacaaatattgcggcatgtaaacaggacattatatatatgaacagatgaagtgtgtaagagtgaggtggacggcaatatgtgagtataggaatgataaggtcagcgtagagggcagaaaaaaacatggtggcatgccagaaaagcaccaagtcatattaaatgagatggaagggatgctgaattgatataagaagaaaacaatggcggcgtgccaaagggtcactattagtaatgatatattgaaatcaaagtaagtttgaatactgtatcgaatctgtggtaaactggattgggttcaggtatgttttgaaactgttcgagttgtttttgtccttgaggccaaatgattcttgattttatcgaagctttattaaaagttaatcaaggcatgcaaaaatcttgatgaaaaattatttcagttgaatgcagctcaaaggaaataagattttgactgatatcaactttcttcaaacggggctataaaaggaacttgggaaagctgtacatatacagtccttcaaaaacaaaaccccggcaaattgaaaaagcaaaaagccccttcccaggaggaatgttagaatttaagtttttttggacatgtttcacttatttacattctatacatatttacaaaaatgataaaaggttgctgccgacacatttgtacctacatagaaaatgttgaaaaggaaaatagtcttactgaaaacgaaccattcttataggatgtggtgtacaaattgttgcaactaaatttttttaattttatttttgtagttcatgatgaaaaatattttttcaacaagttccattgagaatttggtgaaacaaggaagaacagcttccgccacctctgcagccttttcaaattccttgaatttactgattcatttcaatttttccatttttttttatatttcatgctgtaaatggcattgccaatttacttatctgaagatgaaccacatatcaccaaagtaaaaatctttcatttcttcaatatcatattgatttaacatacagatgtttgccgttagcaaagtatgttcaactaactacatatatcaactgatgggataaaaattgcaattgtattattaaaccaacagtatcattatagcaatataattctacatgtgaaataaaaatttcactctgttctgaagcctagccactgttatattattaaattacagttacagtcaaatattacaagactagagtttatggaacagtctctaatatgggagatgtggcaccatacattttcataaatactagcagtttgtagagatataaattatgactgttacactttcttgaaaatatgcagtaatagtaaaaaaaccctgatataggaaatttattatacaaaaattaacaaactgaaatccagaacacccaacacaatattcaaacattcaattatgaagatttgattcatatttatatgtgtatctcatgatcaaaagttaattatttatgtacaagaatcttcagaagtactagatgaataataaagtactagttttcgaaactgaccgaaatttgaaagattttaaaattatttccaaaaccaacagtgaatatcgagattacatagagaacgatccaaagcagacctcttttattattataccactcgtcgcacttcaaaaaaccgtttgaggtaatagacttgacctacagtcatagctaccagaataagagcttcaaaaaaggaccacataacaacacgtgaattggtactttcgttgatgctgcgatgaatacggtcacgaacttgcatatactcttgttcctgtttaactccgccgagagatccactcagttctttaatcatttcttccagtttattggttgtttctccttcctgtgtttctgatttaggagattccccaactgccatgttgaacatcacaactttgggagtcattgttgacattttgttagagaaacaataagtataaacacccttagtatgggcagcaaaggtatattttccggacgtttctctctctccttgatatatatttttaccatctggtcctatgatacgtacatctatatctaagaagcctccttcagctatctcaaatgtaaggcccatttttgtgccagcctccactctgtcaaagaaacattcttcagcatgtgcatcgactgttataaaataagctttgcattggtttacacaaaaatataacaataatataatatatgtaattctagtcattatatagtttgcgaataatttttaacagaactatgttttgatttgagccacgtaacctcctatttcgtataacatgtactagggacacagaacaccctaattagttagtagttagggtgttctgtac

SEQ ID NO: 279 - DNA, 1549 bp, Leptinotarsa decemlineata
  Annotation=Protein farnesyltransferase subunit beta, putative; Tribolium gene name from OrthoDB database=TC010122; Blast E- value Tribolium Gene vs. Leptinotarsa Unigene=0
gaagaagagaaaagagaataagtagggcttatgttaatggtttatgaataataacaaatgtttttaaattgaaaaatgagcaatggagtcaatattaaagcttcgtcctatatcagaaataaacgagagcgccttcaatacagaaaattgcccaacaaaaatcctcagatgaacaaattgatgtagaacgactagtcttgaagaaatacggagatctacaggcaagattgaaaatcaattcaagcctccctgaactactgaaagatcaacacaggagctatttgtttgacaacataagctacctatcctccagatacgagtgtttggatgcaagtcgcccatggctgtgttactggattctccaccccctgtcccttatggggataactttggacaacaggagaaaggccagtatcgcaaggtttttatcaaagtgccagaatccggacggtggcttcggtgggggcccaggacagttttcccaccttgcagccacttacgctgccgttaactccctagtcattctcgggacagaagaggccctgaacacaatcaacagaaaaacattgcaagacttcctttggagagtgcggcagccagatggatctttcgccatgcacgtggggggcgaagtggacatcagaggagcgtattgcgccctgtctgtggccagtcttgcgggtgtgatgactccagagttgtttgataggacggcggaatggatagtcagctgtcagacgtacgaaggcgggttttccggatgcccaggcatggaggcgcacggagggtatgccttttgcgggttggctgctctggttatattgaataagggccacctcatcgatgaacaagcattgctgagatggctcgtgaaccggcagatgaagttggaaggtggttttcaaggcagaactaataaattagtagatggttgctactccttctggcaagggggagcttttcctctgctgtactctttactcgacaaagccggaaacatgccttccgaccatctctttaacgaatgtgccctacaagagtatctcctggtatgttgccaaaatccagatggtgggttgctagacaaaccagggaaacctagtgatatctaccatacgtgctacactttgagcgggctatcagtggctcagcatttcaaaggcattcgagtgctgagctctcggaaaaatacagtgatgacgacgcattctttgtacaacataagaaccgatatggtcagaaaggcgttgctccacttcaacaacttaggtttacctgcagaaaagaactccacgtgacgacagttttttcttgacaaaataagtctgttccaatgcggcgagcttttagggcgcgtccttcagattctcaccctcagagatgtattttgacgtattttatgaacccgtttttaaaggcatttctagagataagtcacaattgaagttttattatcggagtgccgttttattccaagtacgtagcttcaatgtgcctcactttacttatatttgtagcgatttacaacaaaataaagtcttttagttga

SEQ ID NO: 280 - DNA, 764 bp, Leptinotarsa decemlineata
  Annotation=Mediator of RNA polymerase II transcription subunit 11; Tribolium gene name from OrthoDB database=TC014428; Blast E- value Tribolium Gene vs. Leptinotarsa Unigene=3E-71
gaatacacatagacaagaaataaatttttatataccactcttcaactcaagatacgagaaaacatttcattgtcagagtagtagaacaaatgtgaatctcaaagcaccagtaaatttaatgtgttataattttaatttagtatgtaacatgtgtgacattaatggaaactctttgaactttatcaaggattgtatcttacatagaaccttacaaaattttaaactaaaaattacacctgcagtcaaattaagtcgatgaaccaggaggaatattagaaccacccacattgaccatttgagaacctcctggctgtacttgtaaacttctttgggcagttcttccttggacatgtttgattttgtacctttctaactcattcaccctagatcttgcatgctctagtctatgccaggccatttgaagcaccttctgagaagcatagcctgacccctcatgtggttgtccagtagatacttgtgtaagataatttatttgatctgtgagtttattttccactgtactgagtgttttcaaaaacatttgagtatggttttcagcttgtttgaggcttgatttctctttactcagctctacaaagacttgaccagcactatgtaagcaagttattatatctttttctatagaatcgagaacttgaatgcgttccattggagcggccatcttattttttatcgctcgcactaattggaaaaataatatctgaaaacagaacaaatacaaaatcaacaataacaataacaac

SEQ ID NO: 281 - DNA, 1366 bp, Leptinotarsa decemlineata
  Annotation=Putative zinc transporter; Tribolium gene name from OrthoDB database=TC013479; Blast E-value Tribolium Gene vs. Leptinotarsa Unigene=2E-45
cataatcacattttattagaatgaatcacattacagagactatcacttcaatatcaaatctcgtctattttaactttacataaaatactgttaaaatacatatttacattaaaaaatatatcactaaagaattatcataaaatttatggcaacttcatcaacacagcacttctttgttccttattcaaaggcatttgtaatagtagccattaaaatgattccaaatattaaagctaatagttgtttgaaggactccttagggtcttcttctttgagtaggtcaggaagaacggtgaccaatgcgatatgaagaaacgtccctgcagtgaatggtaaaatccaggaacttctcgcctctaatgatgtgcttgctccactgaaaacgatggaagccatcgctccgattaaaccaccacctgcggtgagtatttgatagaaagctgcctgccatctcgtgaaaccagatttgagcaaaattgcaaaatccccaacttcgtgtggaatttcgtgaacaaggatagcgaatgtggtgaaaaagcccagccttgctgagaccaaaaaggcccctcctagtgacagaccgtgagtgaagttgtccatcgtgttggctactaggttcagataaccagtcatggcagattttttgaattcttggggctttaagcctttggtattgttgttctcaggagtagttactgcatttttctctacaattttttctatcacagtgaatagtttttcggcagtcacaaacacaatgagaccagttaataataataaaccactagtggatctgtggcgtccaccttctttagctatattatcgttttcccaaatttcgggtagcgagtgtaaaaatacatcccccaacaatccacctactgcgaagcttaagagggttttcagtcggttggcaccagctccttgttttagattgtcagtttggtcaattggaatgacaaggagaggcaacactccgctgagtccgacaaggatggaaccaaatatggcccataaccatgggatgtattccaaagtacaaatccatcctggtacgaattccttaactatttccttgaaggaaccgtcaaattgagtactgtttgtgtccgagaggcatacgaaactgtttccaagaagtgccatttttgaattttgatcgacatataaattccactacactcacttaaataccgatttaattccggaaaggaataatctgccgactaatctactctgagactgagccggacaaattatatatatgaaaattaagaaatctaatcaaatctcactcattttataccacatctacttatcagtgtcgtgtgaaccattctcattctttgaacattaaacaaaaaaa

SEQ ID NO: 282 - DNA, 1755 bp, Leptinotarsa decemlineata
  Annotation=Metaxin-1; Tribolium gene name from OrthoDB database= TC001214; Blast E-value Tribolium Gene vs. Leptinotarsa Unigene= 4E-73
ttcttttgtgtcatgtagttacggtaacctcaactaatggcgagattgtctcacaacattttcatgtgaaaacactgcaataatcgaaaaaattccacgtaaaaatgagtgttcaagataaatttcagttagtagtttacgatggtgatttctcgttgccgtcggtcgacatagaatgtctaaaatcgatagtgtatacgacgatagcgggggtcccagttcaggttcgtctgcttgacagcgtgaaacaatgtacattttacagtgccccgagtttcgttcataagaatttacagttcaaatcattcaacgaaagtgtgttgtatctgcgaacattgaattataacctagacggaaatctgacagcgaagcagtgcagtgaaactcttgcgataacgaatttagtgctctcgaaactgaaacctgtgttggagttctattactgggtggatcaaagaaactcggaggaatttactagtgtgtggtttatgaaagctctcccgtttcccttcaattacttgcatactaggaggttcaaagaaaagtcgctggctctaatagaaagtttgtacccaactgagactaatttggatgttatcaaggaatttctgcaacgagcagccctcgagtgtttgtcaagtttgtctacaagattgggaaattctgattactttcacggtaccgatccgacaagtttagatattatcgtttattcatatgtatcgccgtttatgaaacttcctttccgtccaatgatattttgaccattctcactatgtggccaaacttgaagaatctagtgaaaagaattgatgccaagtattttcgaaatcttcctcgtggaccgaagtatctgagagtggaagaaaaagtgaaaaccagtgatgaagaagtttcttatgtggccatactaattttgactctcagtgctaccacattagcattaggatttgcattcaatcgagggcttttttccaccagagtattatattgaaaagtcatttttgtagatatttgttgaacatttatctgtgtcatgttccaataaagactgatattattgaaatcttcatatcattgaaggtccattaccttcaattggttggcaaatcgtatttaaaaaaactatttcaccctccaaaagtgattaatttaattcattgaaaagtacttaattcaggtatgatttttgggtgcttctacaagaactataaaaaaattatttatttcacctcatcaaaactttgatgaataggtaggtattgtcaataaacgtggaaggcatgaaataaatatatttcagggaaaactgagagcagctattaacagccccattaaatctatacatatattaatattttttataccatttccaactaataactatagatattttataggttaatttgcacagtttcctaagtaatgaatttaatgaaattacttatataaaatgtctttcaaaagatagaaaatgatcatgtaattcaacatcggcaaaaaagtatttgttctggtgaactattttctttagcttgtatttgaaaaaaagttatgaatgatttcaatcaagcaatttcttcaatttttattattaatttaaataaaaaaaaatacagaatcaggcatttttttcatctcgacaaaactcataagctaaaaactataaactttcgaaaagagctaataatttgaaataagtcaagtaattgttataaaaaaataatttatatttgaaagttaaaagtacctatg

SEQ ID NO: 283 - DNA, 912 bp, Leptinotarsa decemlineata
  Annotation=Transmembrane protein 208; Tribolium gene name from OrthoDB database=TC003864; Blast E-value Tribolium Gene vs. Leptinotarsa Unigene=5E-81
gtgaagtaccatatattaaaaaattgttcaagaacatttcacacaagattaccattcagaaaaaaataatacatattttccaagaaatgccatttttaagacgttctcaattaaacagtttttctttatcacacacacacctcactcacaaattgatgtaaagttaagtttggacatctcaaacaatgaaggaattacaatgttgtaaactgagtattttctataaatagaaaattatcgttgcattcgcttcatctttctttcgagcttcttttgctttttttcattcacttctggttcatttggagcttgttggaagaaatatggctggaggatatttttccatgctatccaacctcctcttgctggagctagaagccacaatagccagaaatagttggaaatgcaggctgacaatatttggcaaccggctgttaaaattattatatctttgacatgctcagcaatgcctccctccatattcagatcaacgccactatcaatcaactgtccagaatcggtatatttagcttttgccatgtatatcataaactggtaacaaccaatgtagattgcactcgaaaaaatatataataaaatacttatcgtactgtaataaaagacgagtatcatcagtgacaaggcattggcaccaattgccatgtttctataaaagtttaatgtggctacattttcttccactatctgtttggctcctttcgtaccctgtttccctttttgtagaggtgccatctctgattattgtttttaatagtgaaagttgaattttgtagtctactgatttgcgcaattcatgacctggcaatatttatactcatttttaaaagtccacgttggaactgcttattttcattttctcttccctttcccctaattcaatttaatttactc

SEQ ID NO: 284 - DNA, 3042 bp, Leptinotarsa decemlineata
  Annotation=Serine/threonine-protein kinase PAK 1; Tribolium gene name from OrthoDB database=TC002075; Blast E-value Tribolium Gene vs. Leptinotarsa Unigene=4E-97
agctagtggtattcaacgtctagtagttacttttttttttttttttttttttttcgttcttcaaatattttttttattcacttgtagctaaatacgaatacaaataaatgtataaaatacttttatatcaattgataaagctcgaaaataatatatttacatgtctaataatttaaataacatcagtacaaactcggaaatatatccagacattataaaataaacaaaaaatgagtttttctcttgtcaagctgtcagagaaccaatacaacttttggcacacgcgtcaatcaataaaaatttttctttcagaaaactaacgctgaacaagcacacacgtaagtagcattaagtctggtgacaatgtcgctaaaaagagtataaataaaatatgctgccgaattacaaaactaccagtgtgtgggaatcaaagttcgctcgagatctttattgctctacgagtcacacagacaacacaaacaaaaatgtctgaataaaattcaaatacttcaatcaatttaaaggtattatcacttggcttttcagtgattaattatcaaatatcacatgatacggtgatctggctatgaaaatatctttttttctctcgactatctataccagaagacagcatttcagacagctatatgcaaaacattttaaaattatatatatataaataaaacgaaacctcgtcatacgagatcatctttaaattaggcacagtctcctgtcgatataatgtaattgaaagttcagatggttgaaacaaaatgcttgaaattcacacttcaaaacctgaagtttatggttaatatatacttacgaaagaaagactttccgcgcggcctgaacttacattttgaaagactgcttttgagaccacttcgaattttgcttactccaactgaactttcctattaaatgcttatatttctaattataaaacaacctatattactagaactgcaaagcggtaatataaaactttgaatcatattctactattactacctatacatatataatacaaggtctaatataaaatgatgcacttctagtaacatgggatatagtctgacacatggataaaattccacacaagtttcaaaatcatttcaacgcaagggctagtgctgttttgctgcatccttagctgctaaaattagaggagtcaaactagccaaaggtcgagcaagtttcaagaaaggatgcttcagcaagtctttcgcagacgacctcttatcaacttccacagccaggcagttatctaagaaatcttgaaaagcgggcgacagtttctctttgtctttaatttcaggtttcccattagtggcaatgaggtacaaggctctaagtggattttcattcaggtagggaggctcaccttctatcatttcaattgccattatacctaaagaccaaacatcgaccttgggaccatactgcttcctagtaaccacttctggagccatccaatacggagttcccaccatggttgtccttttcgactgttcgggacttatttgagcgcaaaagccaaaatcagtcaatttgaccgacccatcgagtcccagcaatatattatcagactttatatccctgtgaatgacttggttgaatgtaagaagtcaagcgcttgaagaacctccctacacacagccgcaatttgtccttcgtccatacaggtttcagtaactacatcagtcaaggaaccgcctggtaaatattccatcacaacccagagttcctcattaactagataactgtctaaataattaacgacgttgccatgtttgttttctcgcataactagtatttcgtttatgattaattctttcttaggctgttgtgataggttcatctgttttatggctacttccattccggttgccgtttctattgctgtatatacagtaccggatgccccttgtccaattttatctaattttgtatattttctattggggtcgcctacggaaacgatacttcgcaacctctcgagaatttcttcatcagtcattttctttttccgtttttctgaggctgccctagacatttcaggacctgcttggtttttgttcttatcgagtacgggaagtgatggagtacttgtggcattcgagttggcagcatgtgtaggagttaaattcgaaggactgagagtgttcgtacttgcaattgtatttgttggttctggttcttcttctactggtttcgtataaatactcttagtacgttcaggtctgctggcaactggaggtggaggaacttcttcttcaatttcacaactaactacgtgtacaggactatgataaggctgttgcccaccctccgcctctgttggagtggtgctactcggacttgaacttgaaactctactaagggtggaaccacctgaatgtgttgttgctgtcttagtcatatacttggtgtttggggtttccttagaactagtatcataccaatttaggacatctaacacagcttggggattgttcttttgttcctgcttacttatattggagttcatcagtaaacgagaccatgcttctggcatccccgtgaactctcctgatattggatcaaaaccaacatgtactgtgtgttcgaaattagttgggtaagatatattaggtttgtctgaggcatacgttgataacttgtgtgtcttctttgatttggggtttttctttttcttgtctatgtcatcgggttctttgggaagaggcctatctactgctatagagctgtttaccagatcagtccccctgttcgatgttaagcgaacaggaggtgcagggggtttttcatcatcagaggacattttagtttataagtacaggcactatttttcgaaaattcactgaacaagttctagccctattaaaagactactacgactgtaaaaatattgatggatatttaaacaaaatacatgttccaatcaaaattcaactcctctactagggtccaccatcttgtcaatttgtcatcattaaactgataatccccgaacgtttagtgggtcgtctctgtttt

SEQ ID NO: 285 - DNA, 3006 bp, Leptinotarsa decemlineata
  Annotation=Serine/threonine-protein kinase PAK 1; Tribolium gene name from OrthoDB database=TC002075; Blast E-value Tribolium Gene vs. Leptinotarsa Unigene=4E-116
agtttaatgatgacaaattgacaagatggtggaccctagtagaggagttgaattttgattggaacatgtattttgtttaaatatccatcaatatttttacagtcgtagtagtcttttaatagggctagaacttgttcagtgaattttcgaaaaatagtgcctgtacttataaactaaaatgtcctctgatgatgaaaaaccccctgcacctcctgttcgcttaacatcgaacagggggactgatctggtaaacagctctatagcagtagataggcctcttcccaaagaacccgatgacatagacaagaaaaagaaaaaccccaaatcaaagaagacacacaagttatcaacgtatgcctcagacaaacctaatatatcttacccaactaatttcgaacacacagtacatgttggttttgatccaatatcaggagagttcacggggatgccagaagcatggtctcgtttactgatgaactccaatataagtaagcaggaacaaaagaacaatccccaagctgtgttagatgtcctaaattggtatgatactagttctaaggaaaccccaaacaccaagtatatgactaagacagcaacaacacattcaggtggttccacccttagtagagtttcaagttcaagtccgagtagcaccactccaacagaggcggagggtgggcaacagccttatcatagtcctgtacacgtagttagttgtgaaattgaagaagaagttcctccacctccagttgccagcagacctgaacgtactaagagtatttatacgaaaccagtagaagaagaaccagaaccaacaaatacaattgcaagtacgaacactctcagtccttcgaatttaactcctacacatgctgccaactcgaatgccacaagtactccatcacttcccgtactcgataagaacaaaaaccaagcaggtcctgaaatgtctagggcagcctcagaaaaacggaaaaagaaaatgactgatgaagaaattctcgagaggttgcgaagtatcgtttccgtaggcgaccccaatagaaaatatacaaaattagataaaattggacaaggggcatccggtactgtatatacagcaatagaaacggcaaccggaatggaagtagccataaaacagatgaacctatcacaacagcctaagaaagaattaatcataaacgaaatactagttatgcgagaaaacaaacatggcaacgtcgttaattatttagacagttatctagttaatgaggaactctgggttgtgatggaatatttaccaggcggttccttgactgatgtagttactgaaacctgtatggacgaaggacaaattgcggctgtgtgtagggaggttcttcaagcgcttgacttcttacattcgaaccaagtcattcacagggatataaagtctgataatatattgctgggactcgatgggtcggtcaaattgactgattttggcttttgcgctcaaataagtcccgaacagtcgaaaaggacaaccatggtgggaactccgtattggatggctccagaagtggttactaggaagcagtatggtcccaaggtcgatgtttggtctttaggtataatggcaattgaaatgatagaaggtgagcctccctacctgaatgaaaatccacttagagccttgtacctcattgccactaatgggaaacctgaaattaaagacaaagagaaactgtcgcccgcttttcaagatttcttagataactgcctggctgtggaagttgataagaggtcgtctgcgaaagacttgctgaagcatcctttcttgaaacttgctcgacctttggctagtttgactcctctaattttagcagctaaggatgcagcaaaacagcactagcccttgcgttgaaatgattttgaaacttgtgtggaattttatccatgtgtcagactatatcccatgttactagaagtgcatcattttatattagaccttgtattatatatgtataggtagtaatagtagaatatgattcaaagttttatattaccgctttgcagttctagtaatataggttgttttataattagaaatataagcatttaataggaaagttcagttggagtaagcaaaattcgaagtggtctcaaaagcagtctttcaaaatgtaagttcaggccgcgcggaaagtctttctttcgtaagtatatattaaccataaacttcaggttttgaagtgtgaatttcaagcattttgtttcaaccatctgaactttcaattacattatatcgacaggagactgtgcctaatttaaagatgatctcgtatgacgaggtttcgttttatttatatatatataattttaaaatgttttgcatatagctgtctgaaatgctgtcttctggtatagatagtcgagagaaaaaaagatattttcatagccagatcaccgtatcatgtgatatttgataattaatcactgaaaagccaagtgataatacctttaaattgattgaagtatttgaattttattcagacatttttgtttgtgttgtctgtgtgactcgtagagcaataaagatctcgagcgaactttgattcccacacactggtagttttgtaattcggcagcatattttatttatactctttttagcgacattgtcaccagacttaatgctacttacgtgtgtgcttgttcagcgttagttttctgaaagaaaaatttttattgattgacgcgtgtgccaaaagttgtattggttctctgacagcttgacaagagaaaaactcattttttgtttattttataatgtctggatatatttccgagtttgtactgatgttatttaaattattagacatgtaaatatattattttcgagctttatcaattgatataaaagtattttatacatttatttgtattcgtatttagctacaagtgaataaaaaaaatatttgaagaacgaaaaaaaaaaaaaaaaaaaaaaaagtaactactagacgttgaataccactagct

SEQ ID NO: 286 - DNA, 1897 bp, Leptinotarsa decemlineata
  Annotation=Protein ERGIC-53; Tribolium gene name from OrthoDB database=TC012578; Blast E-value Tribolium Gene vs. Leptinotarsa Unigene=1E-44
aaaaaactagagtttctattgaattcttacctataaacatttaaaaatttgttacacaaacatataaaaatatgtcttacaacaattatcagccaaaaagaaaaaactactctaaaagagaaacaatgtcatttgaaatggtagatgtaaagagagtcccaataatttacaaaggttttctcaagagaaataaaaataaatagtgagttcgtacaaaaactgataaggaagacgaaaattgttctgaacccattctatactgtttccatcaatcgaagcttgactgttttttcctacaaaccaaccactagttaatctctaaccttcacaactcaatagaatttcttcgcttggctatccttgctatccctgtataaattgtacgctaaaatgattgccaactgccccgcagcgatcagcagcactgctgtcactgatacgcatttgatattttcacagccttgttgagtacccccttggtggctcagctgggctaggttctgtttgacgtgattaagtccgtccctcatttcggatattagagactgagtatcgtagcccacggcctggacttgggctgttggctgcttggcctgattgttaagaatggtgtcagctctttgcttcaactctaggatgaattgcctcagttctttcgataagtttataataacattttggttagtaaatacagcatcgacctcgtgtctttttatggtatcaacatagccccctcccacttgaccgacttgaggagctcctcctccctgtggtacgccaccttgctggcttattagactcatcgttctttcttgcctgcctactacttcgtctagtttcctgttgagttcctttataacttcgtagatttgattctggccttggaaaatttgcctcaattctctttgagagtctgattcataccagtcgtccaaatccggttctttctcatcaggatgctcttttctatattcagctttctgatcttccaatttcttctgataatcctggtattcctgttgcaatttttgttgctcctcaccagtaacttgattagactgtacttgtcctggaggatgcaagctgttggtgaggaagtgaatgacatcatggtcatcagccaaacctccagtagctgccgaaataccgaaatatccgttcttgggcaagaaaacattttctgctctcaaacaaacttcatagtcttgttcgttatttgtcatcccgttatggaataatacggttagggtgttctggtagtactcaatacgtgccctggttgggaaaggcttgtttcggaagtctctgagacacccggcaagttgctgtgttgtgccatcattctggtgatcaaactttttagttccatcattgataacggccataatataagggttattgtgtttattgtcattgtcgaacgaatcgaaaaataaaccaagaccgacccactggtctgatgatccgaaaacttctccatcataagcccctttgttttgagtgtaccagaatgccaaaccatcagctcctatcctaccccttcctgtgattctaaaagagatgtctacatcccaccaatcgaaattgactggctgcttgatccatatggcacctttctggcttctgagcgaaggggctattctaacattttctgaactggcaatagcattaccgccgtattcccaaaatggtactgagccgtctttttgggctagatatggaggtttaaacgaatatttatattcgaatttcttatgtactacatttgcagcagtgtaatttatcaaaactaataaaatacaaattaaattagttaagcactccataataaatttaccacttgtaagtttgcactggcgcactggccacttattcataaaaaacttgacttataact

SEQ ID NO: 287 - DNA, 1657 bp, Leptinotarsa decemlineata
  Annotation=Forkhead box protein N3; Tribolium gene name from OrthoDB database=TC030764; Blast E-value Tribolium Gene vs. Leptinotarsa Unigene=5E-98
tcaacgtctagtagttacttttttttttttttttttttttggttaaacggaacaaaatatattataattaattttcaacaattcaattatttttacataacaatgatattgccattttctatgaacttcatattataaattacctatcttccttatatattacttcctgttttgaattaagtaattctccattacgggtaataagttttttaattttctctctcttttttgatcgaggtggttttaaagttttaaacatcacttcttgagtttcattcttgttgatatcgaactggggacatttcttctcttttttaggcaattcttcgaaagtatcatttgaatcagtgtatcttctttttaacgttactccagccaaattcagtaaagtttctgcacctttaattttttgttgttcatcatcttccaaactgagtttttgtctggtacaatttcctggaaccctgtaaccagcacattctaggggctccaattctattcttatggaattaccactatctgccgaactgtatgtatgatcttgactaggtgaagtcataataactggtggacattccatatttttaaaacttgttccacggtttaaactcaacatcacagtcgcagcatctacagcttctaaagaatctaagttagccttataatctgagtcatcgatggtattttcagacagttctctggctaaggaaggaaatcggtctgaatctggtgaatgggaagtagatgatttattagaaaaacagtccagagatgatgaattgttgaaagtagacaatgaatttattggcgatctattaagagcctggattaaacttggtttatatttaggatctattgtccataacgatcccttcccaatattagttgctttctccactttttgaaaacatttattcaaagacaaattgtgtcgaacactatttttccagcccattggtgctgtcttgaaataaggaaaatgattcacaatccatgcataaatttcttttactggtaatgctttttgatttgaatcctcgatagccatgaatattaaacaagagaaagagtaaggaggtttattatttgtatgaacagatggatcataaggaatattatttggatgtttgtttcgtagtgtggttggagtctgatgaggaatagggtggacagaggaagaatgcaaattgctggttaacgaatctggtacttcagaacaacccctcagtgatcttccagtaaaagtattattattatcaatgttttccacgcaatggctgctaacagtattcgatgaagatggatcaatgttcatacctttcaacaagtcatgctcatgaagccaattcaaattagtcaagtcatcgtcacttctgctttgactttgtgctactgccaacaaaatagaaataggtgattgagcattttgaatgggaattccagcaacaggacttgctggtactgacattactggagttggaacattctcctcttgaggcgtaagtgccctctctggtgccatttctagctgattctcaaaactccttcaagaaaaaaaattctcacataatttttggttcaaacacatctcttatctaataattatttcaaaattttctttgaccacattttcacattccacataactacaacagtc

SEQ ID NO: 288 - DNA, 886 bp, Leptinotarsa decemlineata
  Annotation=Oligomycin sensitivity-conferring protein; Tribolium gene name from OrthoDB database=TC000462; Blast E-value Tribolium Gene vs. Leptinotarsa Unigene=4E-1; Blast E-value Tribolium Gene vs. Leptinotarsa Unigene=07
cttattgaatttattaaatgtcattttacacattaaaatggatctttataagtgtataatgaaaaatgtactatgaagcaaataaatagcatattcactatttcaaaatctatatttagtattgatcttcacataattagacagcagtgctgataatttcagtatatttttttattttgctagccacagacatgtctacatatctgtccccaacactgacgatcattccacctataatacttggatccactttagtagtcaaattaatggtctctttaggtttcaaaaaggatttcaaaaccgcttgcagtttttgtttctgatcagaatccaattccttggcagtaatgacctcacatgtaacctctcctctgtgagcagccatgattgttctgtaggcattaataacgccgtccaattttcccaatcgaccgttctctgccaaaagttgtaaaagattatccgtttcagatttcaaagaaattttttgggcaactactttaagagcatctgactttgagctacgctttacggttgggttttcaattattcctcgtattttggggtcacttttcattgaagtttgtaacttgaggagatccttctcaacaatttcaagggtttttcgtttacttgcagctgagtacaaggcagtagcataacgcccctcaatgccgaaaatttgaactggtggtttcacgagctggttcacaacattgcttgtactgaaagtacgtacagccatagaaagtttttgagtagccatcttcagatatgaaaggatttattcgaattgaaaaattcgacaacttcaatattacatcaacttccactcaaaaacttgaaataggagtgtcagaactgtcagatgccagaattgtcagat

SEQ ID NO: 289 - DNA, 2570 bp, Leptinotarsa decemlineata
  Annotation=Kinesin-associated protein, putative; Tribolium gene name from OrthoDB database=TC013715; Blast E-value Tribolium Gene vs. Leptinotarsa Unigene=0
gttgcaggatattgtttaaaatggagcccgaagatgctaagtatatgagaacggaacgaaaacctggttctatcgacgttcaccccaattttgatgctatcgttctgaattatgaactggatgttcagattttggcgtctaaagaaaatgccatttatggtgaaaagaagaacctcaaaaaaatcattgatctacctatgatcaatagtagaacagattgccatgcaatgtccaaagaaattgttaaccagtgcgacttgatacaccattctcgacttgctgaggttgaacaaatcatatattatttaaaaaagagaaaacttcaaaatggcattaagggtgcttcaattaatttgggagaaatggacaagagtacagaaaaaactagtaatggcaacttggaaccaaattacaataatttgtccgactacattgatcttttgtacgaaggaatgaccgaaaagattaaaggggctcagttgatacaactactagctagagatcccgaaaatttagaagctttggccagaaacgaaacattgataagtgctctaggacgtgttttaagagaagattggaaaagaagtatttcgctgagcactcacctggtttttacttttttctgtttttcaatgtattcttgcttccatgatgtcattttaaagtgtaaggttggatcgatatgtatggatattatcgattatgaattgagaagatacgaccgatggaaagctgattttgaaggatccgaagttccctccgacataccaattgtgagaaagccgtgcccaagcagtgccagtatgtccgaaattccaagaagccgcattcccgagcctgttcgtcccaagtcgggcaacttcacggatactaatttatcccaaattatggaaggcagtatttatgaagatctcactaattcaatggaatgtatagacgataagaaattaaccgacgaacagaaactgaaaagattccgaactctagtcaagaagcaagaacacttgcttcggttgccttttacttgcttctgaatatatccgaagacgaaactgtggaggaaaagatgtcgaagagaaacattgttggccttttagttaaggccctggatagagacaatgacgacttactcatattggtcatcacgttcctcaaaaagttatctataatgcaatgcaataaagatgccatgagcagtctgaatgttgtcgaaaagttgcctcgcatgctcgactccaatagtgccgatctagtccatttgactctgaagcttctgttcaatctatcgtttgacaataaagtcagattcagaattatgaaagcaggattactgacgaaaattatgagtcttttgagcgatgacaaacatcaagaaattgttctgaaaatattatatcacttgagttatgaggacgaagtcaaacaccagtttgttgattgcattggactaatcacagacatgctgcttttgagtgtcggaaatgaaaatgataaggcaatggttgcgctatgtatcaatttagctactgatccttccaataccaagcatattatcaaaaaaaacagacttcagtccttgatgatgcgagcatttacttttcatgatgcaatgctcatgaaaatgttgagaaacatttcggataacccttcttctgcaccttcattcatagagtttgttggcgacatagctaaagccattgttgattcgaaagacgaagatttcgttcgagagtgtattggcattttgagtaatatacacctacctgatttagattgggcagaaatattcagacactttgatatggtgaagtgggtaaaaactgttattaccagtaataacacagatgctgaaatggttttgcatgttgttattcttctgggcacggcagcatctgacgaaggatgtgcaaaattgctttgcgaaacaaatattctaggtttgttaatagatttactaaaaacgcatcaagaagatgatgaaatcgtacttcagatcgtatacgtattttttgtgacattagcacatggatcaaatattgattatatagtaagcaaaacagaggcaccggcttatctgattgatttacttcaagataataataaattgataagaaaattgtgcaatacctgtcttaacataatttccgatcacagtaaaacttgggcagagagaattcgaattgagaaatttcgtaatcacaatgctcagtggttgactctagttgattctcaacaactttccatagaggatgatgatgatgaagaagatgaacttccaccttatttgaacacagaatatttgagcacagctgttgttccaccgttgacgggtccaccactgtcggatcttcatgaagacgcagagtcagaaataattgcagatcaggaactcgattgtgattactttgatgataaaaatcaagatgaaatactagatttggagacttgagaacactgcctgaaactttcgctttattgcctgaatcatagcacaatactgaatcacatatggggcaaattctagtcatttattgaataagtgtaataatttaggaataaattatgcttta

SEQ ID NO: 290 - DNA, 1392 bp, Leptinotarsa decemlineata
  Annotation=SNARE protein sED5/syntaxin 5; Tribolium gene name from OrthoDB database=TC007975; Blast E-value Tribolium Gene vs. Leptinotarsa Unigene=2E-51
gagattttacctaatctaaggttttgaaagacgtgtcaaaaacttgtaaaaaaaaagtttaatcgaaattagtaataatacaaaataaatatatttattaatgtatcagcaataaaaagtctagtatctaccgtaattggaaagtatgcatacttagaatttaaggcaacatatgtgatataactgaacttcacctcatcaaaactattatgtggtaacatatttcaataatgcaatgcttcctagaagacgccgaactggctcagacagcgagccccacgcggtagttagtggcgaaagattttggtcccattcgcaacccgaaacgttgaaccatttgaacaatacgtatcccaataatgttcctgctgactactactcgcaagaagatttcatagaagaatacgtcgagcctgaagcagtcatgactgcaagagacagaactaatgaattcattaataccatacagactttacagggtcgcaatatagctagagcagtttctgttcgagacccgaagaaatcgaaagtgatacagagccattcagagtttatgctcattgccaaaaatgttgggaggaatatcgcgagtacctattctaaactcgagaaattgactttattggcaaaacgaaaatctctatttgatgacagaacggcagagatccaggagttgacttacataataaaaggtgatcttagcagtttaaaccaacaaattgctcaactgcaagatgtttccaggaaacaaaaacaaaccactaatggcaagcacttacaatcccattccagcagcgtagtccttacactacagtcgaaactggcgagcatgtctacggatttcaagcagatattagaggtcagaacggagaacctgagacaccagaaaaacagaagggatcaattttcacaaggaggtctccctctcacaacacatcaccagtcacgcaagggagcatccttctgcaagagccagaccaagtgagcatagatctggagagtacggccctgataccaaaacagaaccaaatgcaggcagcgttgatgtatgatcagaccgacacctacctgcaagatcgggcggaaacaatgcagagtattgagtccacggtagtggaacttggagggattttccagcagttggcccacatggtcaaggagcaaggggaaattgtggagcggatagacaccaacattgagcaatctgaaatgaacatcgaagcagcccatgcgcaaatcgtgaaatatttcaactcagtctcatcgaatcgttggttgatgattaaaatttttgccgttctgatatttttctttatatttttcgttgtctttatggtctaattataattttgtaaagagtaatatatatatctttcagacattcatatttaa

SEQ ID NO: 291 - DNA, 1379 bp, Leptinotarsa decemlineata
  Annotation=Prolactin regulatory element-binding protein; Tribolium gene name from OrthoDB database=TC014725; Blast E- value Tribolium Gene vs. Leptinotarsa Unigene=0
gactgtcactgtcagtgaggttagctacgtgtaattttgaattatggatatgtatgtattgttctcaaagtttaccgtcaagtagatcataaacaataaatgaaaagatggttcggagaaaaaaaaatgtcgatgatattcttgctcgtattaacttcccactttttacggttcagatattgtctccaagatatgtaatcgttgggggtggtggtggaattgcaaaaacaggaatagctaatggttttgaaattttcgaactctcccatgatggttccaaattcattgctgaggaagttaccaggcatgaaactgggggaaacgttgtgatgtattgttccactttcactgataacaaacgttcatatgtagtggcaggtcaggaagatcactgtcaactctatcatgtgaatagtgaacttgtcagcgaagaagttgaaaatattgatcataattcgcctgagactcgacaaagaaaaccgcaaaaaactgataggaacaaaaatttgaaaaagagtttgaagtttgtcatgaaacccagtgatagtatacaaactgatttcattggtccagaacctctatctagagtagctaggatacatcataatggtaaacttatggccacaggaggaactgatggacacataagattatggaaatttccgagtttgcaacccttaaccgtgttgaaggcgcacgagaaagaaattgatgacattgactttagccagtttggaaattttctgattactgtagcgaaggatggcttggggattctttgggactgtattaaaggaaaagaatacagtaggttgaattggaaacagcctgaaggttccaaatatttgtacaaacgatgtagatttggtgtaatcgaaggggaagataaaaagtctgcgttatatacaatatccaatcctactggcgttgcaaaaaaacagaaatcttatcttcaacagtggctccctgaagatggactactaaaaaaagttgcagaattcgacgaatgtctttccgctttggcagttagagatgatggtagatttgtagctgtgggtaccatgttcagcggatcagttttaatttatgcgtcttttagtttgcagccaatgttgaatattgttggtgcacattccatgtttgttactggactagaatttttccctgtgttgaatgaaagtcgtactgtttgtagcgtggccgaggctgcagtattatcaatttctgtggataaccatgtttgtatccatacactgccatatagaagaacaatgccgctgtgggtaggaatattgatattaattttcacattgttcctctccttcacattttgctcttatataggattataaacagatgtaataaaatttttttgttta

SEQ ID NO: 292 - DNA, 2031 bp, Leptinotarsa decemlineata
  Annotation=Mannosyl-oligosaccharide 1,2-alpha-mannosidase IB; Tribolium gene name from OrthoDB database=TC007447; Blast E- value Tribolium Gene vs. Leptinotarsa Unigene=0
tttgaaccaaattatttattgaaaaactcccccaaaactgataacctttgtagaaaagactgtcctttgcacgacaacaacatataattgttttcccaagatgcgttcctgggatatttattttcagttcgaaatctttccagcatctcttgagggtcaaacttctttccctccttcctaattatctggctcaatattttcggaaatgaaatttcgtcggcctcatcaagaaacgtgatattatcttgatagtcttcatttgctacactaattttctggctgacactgtcgttatcttccagtttgacgtaagtacttgtggattccgttactatagttattttttcgtcttcaaactcctcagaagtatcaatatcattttgctgtccataaggcacttgattttttctatctctcactgtttcacctctgaacaaagacttctttttttccaattccttgagatctaataagttcttgtttgatatactgtgacaacaatgtaaagcactcggatctacaggatgagcttctgtattgaaaatataacctccagcctctatgacacactctccatttggggtgttgattactgtcccatattgtccctgattgtgaatgaaattgtcagtgtcaaatagaagatataaatactttgttgtttctgacaggaagaaagattccattctgtcttcttttctgtggtcacgaacatctttaatcgttgcatatccacagggtgttttggcactgtgctgtatgcttctcagaatgtcttcaccagcttgcaggagaaaaggatcgcctgtagatctgtacaaatacattatggattcaataagctccggcctcaggggataactctctctattgctaccggcttcagtttgtggaatgtagtagaactctggagtgaacccatattgttgccacacctggtgatagttgtgtagggtacgcattgcagttgatgtgtctcctattaaactcaaaactccaggccaatatgactccaatgactgaaaaaccggcaaagtaatttgacccttggtcattgaaacccacatgtaccaatcgtctttcttcatgtatttgtcaatagactttctagcttcgtggaacatttccatcagttcaggcctttgaagtaagatggaacctttcaccaagtactcgaaaaaagaatcaactcccgatccaataccagcatcttgagcggtccatctacctgaatctatatcaatgtgatttccaaatagcccaagctgagatttgtggttgaaaagagaataaattgcgttcattgcaacctcttcatacaacggatctcctgtgagtctgctcaatgtaccgaattcaactatgaaagtaccaacaccagctgtacatgtaactgtagtttcacctctaggaacgccactatgaagattaacagtcccataaggcataccagttttgctgtcgaaggcaactattaatctctttgcaacatcttctgctaatcttaagagcggtccattacagggccaaccaggctctagttttgcaccagctctatgtgatagcaaatgtgcacttagtagacctcctatgattctgatgtttgtttcaaaaacagatacattaatattggcatcaaagtcagtttttgttgaaagaatatccacgaccctttggaattctgaatgattacccattatcgccagggtgtctagggcatcaatcaaagtcagcgaataacttccataagtatccattccatcacagctcaatggtctaagttcatcataaggataggcatattttaaataactatcataggcatgataaaacatttcccggacttcttctctcaatttattcaaatcgtccttcgtgtaagtccttattgcggcagatatttcaaataaaattattaataagaacagtatttgattccattttgaaattaacatttttatctatttcaatacgtttcaaaatccacataattataaaggttatgttttttgttatgacatttattttttt

SEQ ID NO: 293 - DNA, 807 bp, Leptinotarsa decemlineata
  Annotation=Methylosome subunit pICln; Tribolium gene name from OrthoDB database=TC003587; Blast E-value Tribolium Gene vs. Leptinotarsa Unigene=5E-4; Blast E-value Tribolium Gene vs. Leptinotarsa Unigene=0
tagtcattggtttgttttcattgttaagtttattgatttcaaaaattacaaaaaaatggttattataaattcatttaaatatccggaatcagatattaagtaccagaaagaaaatattcgagttgtattagaaaaaaaggatcttggaaacggaaccctgtacgttagtgagcaaactttatgttggcaacggaacggggatgttggtctaacgatagagtaccccaatatagtattacatggtatctcgaaagatgattctgtttacccaggagaatgtgtttatgtagtggttgcaggaaagattcatatgccaggggaagatccttcatcgcctgatgcagatgacagtgatgcagctgacagtgaagatagttattgtgaagtatcacatgagtgttcagaattattattagtaccaagttcaactaatgatgatactgaagttgtcagacagctttacgaggctataatgcactgtcaggaattgaatcctgatcctgccatggatatggatgatgacagcacaaatgaagatgacaatctctacgaagacgctgaagctgaactgaatgaggagaatgaaattatggaaagaggtggaggtgatgctgatgtagatgacctcacaagaagaatccgtgacaatttccatgacattcaaattacgacaacaaatggacatgatgaagaagaggaatttcaagatgctgattagaattagttttttgtacttttgtatttattgatgtctgattggtagtcatatttataccaattttaaatcatgtgctacaataaagaaaa

SEQ ID NO: 294 - DNA, 2478 bp, Leptinotarsa decemlineata
  Annotation=Gametogenetin-binding protein 2; Tribolium gene name from OrthoDB database=TC012875; Blast E-value Tribolium Gene vs. Leptinotarsa Unigene=0
tatctaacgctagtagtactttttttttttttttttttttttctattattagattttattactgacatagatggtctgatgcgatacatgtgcatcagatacctatacaaaacaacctattttttgttaacaataataacccattatggaatgcaacaaatacatcagtaaatattgtaactgtatagtagcagttccccatttttcgaagactattatattcttttattggctgcttcattgaaaataaattttctttttttgtgcaaatacggagaaaaacaaaataatggaaacagaaacaactttttaggtataattttaaaactgaacattaaaaaatcatggaaaatcgtgtagactctaaaaaatcaattagaagcataattggtttgtaagagtattcgtggcacaggaccatcaacacaaaactgagcaaacctcttctgcagggtctctcttaactcttgacgtttttcatatacctgcctactattatttttgaattctctaacttcttctggggttatataacattcttcgtcgtcatcgtcactgtggccctccagcatttcctgtaaactaagttgttgtccatttcccccataagacaatctacagtgagaaatataatcagagtcgagttggcaacaagtatctgaacaagctaattctgagccttctggtgagctagacaggctggagataagagatccagtttcgcaacacccattgttgttctctgaagaatagccacaatcgtgggaatggtcactgttagagccagtctctttttttgggttgaagtctccataataggtaagaggccctttgtcgcatttgcatgtgatacctctcttgtccttcacgtcattatcacacttgcagtcacctctcttgtctttcacgtcattatcacatttgcagtcatctatccaaagctcatttgtacatcttggtttaccttttttcccgctgagtttcgaatgataatcgtcataatcatcaaattcgttaccactgcactgtctactcttgtcattcggttgcaactggtcacagttgaaacaactcaaggaattgttctgatcctgggaacaagagcaatctttgtcatcttccttgtcctcgtcatcatcttggtcacaatcattgcagttttctttgccttcctgatcaattgtctttccctttctacgtttgcgtttgatctttttctgttccttcctgatctgcttttgttgttcctcccttgcaaactctgcgtacaataattccaactgggatactcctctaatacgttccactgcagtctcaaagcttcgactcaaagtatgaacagcaactgcagcaaacacctggcatgtacattcctcttctcgcattcgcatataaatacgatgcaacctctcgtacatgcagatgcccagacaagtaagcacttcttcttgggctatttccaaagttttagcatgtctttcccgtcgacttcctaatagctcaggttccgcacgactgatcaacttggtgatgtattcggttttggtttgcaaatgaatgtgcttgtctggcaaacatcgccttattcccgcatataaagacgaaacatatcccttttctttagttggttctggttcgtccacaagtagagtataagctttcaaaacttttgttctgcattctccgcaaaatctatgttttcgcagataagtttcaagagtagtatgaagggtagatgcctcaatgatgcaaacatctttcttacaatccggcttcatgcattcccagacatctctccaaacaggtgtcaatggtctggtgcgttgagaatcaagagaatgcagaaggcatctgacacttttcttgttccgttttggctgattttctatcagtttagcaagtcgaatagcatgatcgtgaaatatggatcctaaaacaggataggaaagcctatcctcctttatactaatagttccgtcaggtctcactaccagtggatctaaggtaggatgtccaaattggaataattgataatatagtctatcgacacttcttcgacatccaacacatggaacattttgattcaatacgtgcataagttgagattttgtaatttgaagagcgctatgtaattcttgcgaagacaagactccccacttgcaagcaaactcctccaattcctttccacgtaacagttgattatcacaaatgattccagaactttttatatccataaccaacgttaaattttcatcaacaactaagggcagttgcctcctactaagagggttcgttggacgaaaaacatcaaccagtttgggcagtttttctttattattcatatcaatgaattttcaggtccctgatagaacgtttactctttccaataagttgatgaattttcaggatataaaataaataaagacacttcataaaatgacaactacttccatttgcaatgaatctatcatgaacacc

SEQ ID NO: 295 - DNA, 1966 bp, Leptinotarsa decemlineata
  Annotation=Alpha-1,3-mannosyl-glycoprotein 2-beta-N- acetylglucosaminyltransferase; Tribolium gene name from OrthoDB database=TC009001; Blast E-value Tribolium Gene vs. Leptinotarsa Unigene=0
tgtgctgagtacgttcgttgttcgttcacagttcaatcactttgagaatgacttcttgacatctcgactttatgggtggttataaatttgttgtggattgtagtttataaccgagatatattataatgtagttgaaaatcgggctacaataaattgatatttaggttaccaaatgcaatatgattgatatgtgctgctctgcaaaataaaatttgaatataatatgcgaataaaacgcacaaatttagttataggattattattaattgtatggacttctgtattatatttaacttttccataccattccatcaattccaatgaagtttctgatgtagttaaacaaattgtgattttggaacaaggcatatcaagagagtttgaaaagaacaatgttgtaataaaagacgctcaggagttactagaaattaaaaagaaaggtgaaatacacccaaatacagtagatcagaaagaactgcaagatgttaaaataccagttttggtgtttgcctgcaatagagttactgtcaccaggtgtttggataatttgattcaatacaggcccgatccagatcagtttccaattattgttagtcaggactgtagccatgaagaaactagaaatgcaattcaaaagtatggctctcaaatttcactcatacaacagccagatcaatcagacattcaagttccgccaaaagaaaaaaaattcaaggggtatttcaaaatagcaagacattatggttgggcattaaaccaaatgtttttcaattttaactttagctcagtaatcatagtagaagatgatttggaagtggctccagatttctttgaatacttcattggtacttatcctcttctgttgaaagactcatcactttggtgtatttctgcttggaatgacaatggtaaggaaggtcttgttaacactgatagacctgatttactttaccgtactgacttcttccctggcttgggctggatgcttaccaaaaatatttggtttgaactctacagcaaatggccaagagcgtattgggatgactggattcgtgaacctttgcagagaaaagatagatcttgtattcgcccagaggtttcaagaacgcggacatttgggaaaactggtgtctcaaatggaatgttctttgaaaaacatctgaaattcataaaactcaatgaagaatttgtgcctttcacaaagatgaaccttagttatttgctgaaggagaactatgactacggttttgtaagaaaagtgtaccaaagtccaatcataaactaccaagatctcaaagacgggaaggtgagacataatgttcccactagaattatttataaaacaaaggaagaatataagctaattacaaaaaagttgggactgatggatgattttaagagtggtgtaccaaggactgcctataaaggaattgtaactttttactttaaaggaaaaatggtacatctaacacctgatgcaatatggacaggctacaacatttcatggagttaattaataattacaactgattgtggatggtgcctctacctacggtacttatgtccaatgtggctgccagcaataaaaaatgtttctgtctattttgggagttctaacttagcgtacctcactcacccacttatgaatttagtgttcttgaattgaaagagttgatagtaagacaactagtttgaaagtgctggcatgccccagaagtccaggttaacaaagtaccagcagtgggtgcagaagcaaattgttctctcttttgtatatctcttcctcttcttagttaattaatttattattcacttgtgatatttttgactccaaaacggattttttgaaaattcaattgttatactataagtactaaattgttgaatacttttgtatataaaagtaaaattcacatgtcttgtaaataatggtgataaataaatgagcaaattatggttagtaaaa

SEQ ID NO: 296 - DNA, 1087 bp, Leptinotarsa decemlineata
  Annotation=ADP-ribosylation factor 2; Tribolium gene name from OrthoDB database=TC001463; Blast E-value Tribolium Gene vs. Leptinotarsa Unigene=2E-1; Blast E-value Tribolium Gene vs. Leptinotarsa Unigene=03
cagttggtatctaacgtctagtagatttttttttttttttttttttttttttgtaccctaaaattattctattttgttatttattattttttacacagtaatctgaattgatataaatgtgaaatacaaaggaaagtaattatctgaacagactatccaaactgatattcatggatacacttgaaatttaatagtgaagcacatagaaataatgaatagatatgcacataaataattacggagtatattatgaaaatatcatcattttgctaattcatttgacaaccaatcaagtccttcatacaatccattcccttgtgtagcacatgtagcctgaatgaaccacctacgatttcgcaaagtattcagtttgagcttgtcggtcagttctgcagtggacatggaatttggtagatcctgtttgttggcaaaaatcaataaaatggaatctctcaagtcttcttctccaagcatattgtgcaattcttgttctgcttctgcaatacggtctctatcattagagtctaccacaaatattagaccatcagtatttgaaaaatagtgcctccataactttcttattttcgtttgaccacccacatcccatactgtgaatgaaatatttttatactctacggtttccacattgaaacctatcgtgggaatggtggttactatttcacctagcttaagtttgtataaaattgtagttttgccagctgcatctaatccaaccatcaaaattcgcataggttttttactaaacagtctgttgaatacggcagatatagtaaggcccatggttcaatgatattttatcaactatcttcaaaatgaatggtcttatcaatacgccaggtaatggttttgttcaggagaattatacaatattatcatcactaaacaatgattgagttctttttcactttttgccagattaaccgggctggaaaactaataatttcacgaatattacttagttttttactagtacaaaactggaaaacactccggtgaaaattgaatatatggtaattagtcaaaatattaaaacgtcagctaactactgctgtcagtcagatgtctc

SEQ ID NO: 297 - DNA, 2480 bp, Leptinotarsa decemlineata
  Annotation=Abc transporter; Tribolium gene name from OrthoDB database=TC014809; Blast E-value Tribolium Gene vs. Leptinotarsa Unigene=0
catctgcaatgtatgtcactgtgagacgttgctaatgtctcaccacggctagagactgaactaggcatcgtttttattctgtgttatatatagctgttattatcgatggcagttgctgtctacagacgttctcacatgcgccaagctgtcaaatcatatttcaaagttcaatttttgtgaaatgggggctataataaatttaagtaaaataaatattcaatttttaggcattaatctcagaatagttaatatacacagaaaatttactcaatttcattccaaacgaaacttacaccccacatcttcttattataattcaaggtggtgcactacaaataaggaacagccacaagaaaaatccaaatccagtggtggtattttggcgtttacattgaaaggagctttcaatagcactcccaaaagtcaacctgttaggggatgttttcacccaggagcttcagttctctctcgagaatcattacctttgaaagaccaagatgttgtttctggaagacaaatgatgcagagtatgttacaatatatctggccaaaagatgataaaatgataagagacagggtaaaactcgcagtaggattactaatagcagctaaggcagcaaatgtatgtgtcccatttacatttaaatatgctgtagattatctgaatgccagttctacattaaatatggactcggctcctgaaacagcaactacaatagccataagtctcctagttggatatggtattgcaagaatgggagcaacaggtttcaatgaactcagaaatgcagtatttgccaaagttgctcaaggatctattagaaaaattgccaaaaacgtgtttcttcacttacataatctagatttgggattccatcttcaaaggcagacaggagctctgtcaaaaacaattgacagaggatcacgagggattaactttgttctatcagccatggtttttaatattgttccaatagtatttgaactatctctggtctctgctatattgggcctcaaatgtggagcagcttttgcaggtattgctgtgggatgtgtgggcatatacagtatttttaccttggccattactcagtggaggacaaagttcagagttcacatgaaccgtgctgaaaatgaggctggaaacaaagcaatagattctctgataaactatgaaactgtcaagtatttcaacaatgagacatttgaagctgaaagatatgatcatgtcttgaaaaaatatgaagaagctagtttaaaaaccagcacaagcttggccgttttaaattttggacaaaatgttatttttagtactgccttaagtgcaatgatgatattagcagccaacgaaattgtaaaaggaaatttgactgttggagatctagtaatggtgaatggtttattgttccagctatccgttcctttgggatttttgggtagtgtgtaccgagaagttagacaggctttaattgatatgcaaactatgttcactctcatgaccatggatagtgccatcaagaataaaccaggtgctccttaccttcatgtagatactaaaaatacagccatcaaattcgaaaacatttctttcgaatatggaccaggaaaggaaattttcaagaatttgaatatgaccattcaacctggtaagaaagtagccattgttggtgggtcgggatcaggcaaatccactctggtgaggctcctctacaggttctatgagccaacagaaggacgtatcatcatcggtaatagtgacatccgtgatgtagatgttgagagtcttcgtcgttctatttctattgttcctcaggacagtgttctctttcatgatacaattaaacataacttgcattatggcgaccttaaagctacagatgaagaggtcataaaagctgcccagttggcagaaattcatgactccataataacttggccgatgggatacgatactcaagttggagaaagagggttgaaattgagcggtggagagaaacaaagggtagccatagccagagccattttgaaaaattctcctattttggtgtttgatgaggcaacaagttccttggattcaataactgaacaaaatatcctgaaagctttgaggaacgctactcaaggtcgcacaagcatctgtattgcccatcgtctgagcactattatggatgctgatgaaataatcgttttggaaaatggaaaagtagccaataggggtactcacaactatcttatggaagaccggaatggactttacttcaagttatgggatactcagaatcataaaggagataaagtgaaagttagtgaaagtaaaagatcacatcaaacattgtaatcgaatttttcattgaggtctgacttggtttttagataaaatattcagaaagtaattttgtgaaaactactataagtaataatttaattgtaaatattatgtaaagccataacattggaagagaataaatatgttttatttt

SEQ ID NO: 298 - DNA, 2602 bp, Leptinotarsa decemlineata
  Annotation=Pyridoxal-dependent decarboxylase domain-containing protein 1; Tribolium gene name from OrthoDB database=TC005445; Blast E-value Tribolium Gene vs. Leptinotarsa Unigene=0
cgtaaataaatatttttattatagaccagtcaaaaataacaagtacacatatctaatataaaatacttattacaaagaacaatcacaaatgtaaactttcttgggaacataaaaaactgaaactcccagttttccacaaaataagcaaaaattattggtcgataagaaatacctacaacataataaccatgtttatatatcaacttataacttcgattcgttatcatttacttcaacaaatatttttgaattactactgggtattttattttctatgtttacatttgatatttgacttgaagctgaagcatgactacttgatcttgaatgactccctccaacgggagtttgaatctgtggagagggaggagttttgcctcccgacgcagatatatatcctgatttcatctgcatgtggtatttataaatattttcagtactttcaacgactccctgcgttagatttagacttcgccccatgattccactatcatctttcgttcttggtgaccaccaattcacaaatgttcctactatcggtacatggcgaataatgttttcttgccaaagtctttcttcactttctttctgaagatctatggtagcagtctcaatacctctcttaacaatttcgctcatcgaatcaagaaccctggaattctcttcgacagactgcccgactcgcactacaaggttaagaagctcttcgacgtccgactgcggagtcagcattccaaatctcacacacatcaaaccatcagcaccctcacccagtgaaaaagcagaatctgttgatctgagcgaatcaacaagtgccatattcaaattattcaactcttctttagcttgatccgttagaagctgctcccagccttctggacaatatcttactccccccattcctgcccactcaggaagttcaacaattttcagtacaggagaagcctccaccaaatgaatgaaagtatctctatgatgtatcgtcgctctcagaataactaactgttgttcaagacactgaacaaacagttggatttcttctgcggtcggttgttgtcccataacattctcaaaggggcaaaatctcaaaacaactccgatattttctaattcgcaaatgtcgatgggaacctgtggtgcatctagttgcagaatttgccccagccacgagttgagtttatcataatacgctggaaccttagaaacgaattcttcaccatttaattccggtgtgaactggaacactacacagcaggcagtcgattcaaacaataatgatatatttggcggtttcgttaccaactcggaaactttatagatgccactctcacctccaggtttaggactcaaaactctgacgtgccgaaaaacatccaaagctgtccatagtttttcgcatgctatgaaattttcttttattctagactggactccatcaactccaaggcactggagtcctgcccaaagtggaagagcgattattttgctacagtgatgatctgtattcaaaccagccaataacggtaaggtactttctctacttccccccccttgtttgtttcgataggagttaacggtagaatcccaagcactatataaggtgacaattggtaatcctggaatacccaaccaacttcctaatgttaaagttaaactgtcagacacaggtgacactattccatttcgctgatgatttggtaaagtcagtgccgccagactatggcctcgaagatgtaaccatgcaccatgaactttacaaagttcctttattctagaaatattatccacatgcccactcacgggagtaccggcatccgcaatgactattagaggtgttcttccagcagtcacatcatcagacaacattttctgcattgctgatatatccattgtgtattgagagccaaaatgagtattgactggtacaggtcgaatacaagataatggcaaacccaactgtctgcaaagatgctgaaccactcctaaagggctagctacactgctataaattgttggtaacgaaccggctaaagctaaaacaccatcttccaaatacctcggatatttgtaatgtatcatcattcttgttactctcactaaaccttccagatgatcttcatgataaaaagcagagcagtccaaaacaccaaacaactgactgatccatcttgttgcgtctgttgtaaacctagtgctcagtttctgtaaaattggtctttccagtcctccacaataagctgctagactatgagacacaacaactaacttggtaacactgtctaaatgtggaaaatgcagaggttcattatcatcatcgttgctgatgagactctgtattacttgaactatttcatcagaatgtttcatcaccaaattcaaaaaaactgttgactggccttggccattttcattcgttggtaaacctacagcaacttgttctaacctgcttactatctcagatgcctcgatagcaatgtcttccaatccgctcttttccgtaacagaatccattattgtccataaaattcaacttatcaattcaaaatttaatatcaacatacatcatacatgttatttctaccatttgacagccttgacattc

SEQ ID NO: 299 - DNA, 1358 bp, Leptinotarsa decemlineata
  Annotation=26S protease regulatory subunit 6b; Tribolium gene name from OrthoDB database=TC007999; Blast E-value Tribolium Gene vs. Leptinotarsa Unigene=0
gactcattgtcatttttgtcaagtgtcaagtgaaatgagttttgagtttttctgcaatttcaatacattttaatagcatttgaaaatttagaaacaatggaggctatggaagttgttgttcctgaaaaggaagaaggtagcccttcagacgcaaaacagaccttacaggacgtggatattgaagatttgtataccaaatataaaaagttacaacaaatgctcgagtttttagaggttcaagaagaatatatcaaagatgaacaaagaaatctgaagaaggaatatttacatgcccaagaagaagtgaagcgtattcaatcagttcctctagtaattggtcaatttttggaagctgttgatcaaaatactggtattgttgggtccactacaggttccaattactttgttcgtattctctccacaatcgatcgggaacttttgaaaccttcagcaagtgttgctcttcacaagcacagtaatgcacttgtcgatgtgcttcctccagaagcagattcctccataagtatgctgcaagctgatgaaaaaccagatgtacagtatagtgatattggaggaatggatatgcagaaacaagaaattagagaggcagttgaattaccacttactcattttgagctatacaaacaaattggtattgatccacctagaggggtgttgatgtatggacctcctggatgtggaaaaaccatgttggcaaaggctgttgcccatcatacaacagctgcttttatccgagtagtgggatctgaatttgttcaaaagtaccttggagaaggaccccgtatggtacgagatgtgtttcgtttggccaaagaaaattctcctgccattatattcattgatgaaattgatgctatagcaactaagagatttgatgctcaaactggggcagatcgtgaagttcaaagaattttactagagttgctcaatcaaatggatggttttgaccaaactacaaatgttaaagttataatggcaacaaatagagcagacaccttagatcctgctctgctcagacctggtcgtttggataggaaaattgaatttcctctgccggaccgtagacaaaaacgtttgatattcagcactatcacatcaaaaatgaatttatctgaagaggtggatttggaagattacgttgccagacctgacagaatttctggggcagatatcaatgctatttgtcaagaagctggtatgcatgctgtaagagaaaatcgttacattgttttgcctaaagattttgaaaagggatataaaaataatatcaagaaggacgagagtgaacatgaattctacaaataggtttattttactaataagtttcacttcatact

SEQ ID NO: 300 - DNA, 1396 bp, Leptinotarsa decemlineata
  Annotation=Vesicle-trafficking protein SEC22b; Tribolium gene name from OrthoDB database=TC007954; Blast E-value Tribolium Gene vs. Leptinotarsa Unigene=2E-117
tataaataaatttattttatatatttacaaaatcatttgatgcaatttaaatacaatacactcctgcttcagtgagtgtacaaaccatttaaagactaacactatgaacgcaatacaccattattagaatatataactaaaaggaggtccccaaaaaagtgtcacaaccagaataatgacaatcagtgtttccataatgtacttatgtatgtttgccttagtatctttgcagatttattgattttaaactgaaatacatttaacttgaaggaattaataaattgaacaaacttttttgttcggaagcaaataaacaactgcaaaaagttatatcgaattgtgtaaatgatttttagagaaaggcgcatagtaaatgcagagggcatataattcatattttggtatagctttgattgtaccactagttattgttattttgtaccttccattttttacattcaaggtagcataatagaaacaaacaattaaaatttttgtatcctatctacaaacttatgaacttcttaacaagcataattgtattctgcaatgacctattcagccgtgacagcatcaaatgaaaattttaatgaattttcatggtactattttgtattcctgaatatcaatttggaactggattacatcttgaataattgctgttaagacactttacaatatccagaaataaaaaataaataccagaaaaactattccccctactgcggctttgacatacatcgatttggtgttcaggtaagtggcatcttttttatacttttcagttaacatgacaaattttgagtttttgtatccaattctgataaaactgtccctctttgtaatacatcatcgatattttgaaccataatcctctgaacatcttgaagttgattattaatagtgttcaggtttcttctagacctagaatctgtgaaggttttttttgctttctgtatatacgtatcaaattctataaatgtgtaaggcctggtaacagtgttcactcttttaccgtattgggaatggaattcttgtgcaatgtcctcaagataagaatatgccaaacgtttggagtagtttttctcacaaagtactaaatagcatacttcatattctattaaataatggaataaatatggtccagtttcaatagtgcacctaggaggagattgaggtcctaattttcgaaataacattttcgcctggttttggtagtctagtatacttcttccagactgttcatcttcttgcatagtagctgctaaaggaaggccgtcggccacacgggcaatcatagtcattaacaccattcttgtaattccgttttaaaacagtttttctaacttacaaattacaatctggattaatcgtatgatgtatgattattggttaa

SEQ ID NO: 301 - DNA, 1622 bp, Leptinotarsa decemlineata
  Annotation=Zinc-type alcohol dehydrogenase-like protein C1773.06c; Tribolium gene name from OrthoDB database=TC013567; Blast E-value Tribolium Gene vs. Leptinotarsa Unigene=0
aggagggatctgccactccaaccgttagtattttcgtgatcatctttgtgagtgattctcctcgaaatcataaagaactctttctagttgcttactgaaaaagtatcaaatatgttagcagaagctgtcctaggcgattatcatgatggaccaaacatgaataagctatgccgccaagtgtccatcgaatcaccaggttcggtgatcaaagattgtgtcttcaactttgaagttccagttccggatgttccagctaacggcgccagaattcgtgtagtctgcgcaggagcttgctaccgtatgcgcaatcggtctccgtcgacttccagtatatcgtcagtgtccagtgtacagtccacagaggattctggctgcagccctgctcaccatggaatgcgtgacggagctctgttcccagggtatgaagtagctggtgttatcgacgaactgggatcgaacgtgacatcagatgagttcacgattggaaaacgtgtggttctgtacccttatgatggaatcccccatggatacgctgagttcgtcgtagtacctgatttgtcgtatcttgttgctgtgcctgataatttgccattaggagttgctgctatgcttcccactggagctctcttggccaaaaacgcggttatcaacgcacatgaccatgtcgtcgaattgttgaaggaacgagctgccgatcatattgtacgaatacttattgttggcaccggaggactggccctttgggcgctcaggattgctgagcatcacttcaaaaccccagaatacaaaaacagggtcaaaatcactgtggcttctttgaaggatgaaggtctcatgttagctgcaggagaactcaaaacggtcaacatagtacaatggaatgaagatttatatgaaaagcaattaatagaaagaaccaaagatgcctgcagcggtttagtagatattgttattgactttggtaccacatcgcgatccttgcatagatctctccaatgtctgaatacgggaggtgttgttctagtaagtgaagaagttgctgaacgtttactaccgaaattctcaaggttgatccatgagagaaatcaaaaaattgaagctgttgctcagggatccattgaacaactaaggcagttagtggagtatgtagcagcaggttacataaaaccccctccgcacacagaatttgcagctgatgaagcaccaacagttgtacagaagctttgccagtcagaaatacccgggagagccatattacgttttcttgatattcagtaattgtttgttcagacactgtagtgttgattgtactatttagaaattatttatttatgctttccatttttatatatttttataaaatatgatcttcattctccaccaaaaatacgttgtgatttgtattaatagtaatagggttaagtattatgtatttaatatgtgtacaaaatttccttttgaaggcaaattactccatacacattacattgtgataagctttttattttaagttgatatattttgtatcaacatttaattgaacttttttgtgttttatgtaaatacaataataaattatactatttctcaaatcaacgaaaaaaaaaaaaaaaaaaaaaaaa

SEQ ID NO: 302 - DNA, 611 bp, Leptinotarsa decemlineata
  Annotation=Mitochondrial ribosomal protein; Tribolium gene name from OrthoDB database=TC000079; Blast E-value Tribolium Gene vs. Leptinotarsa Unigene=1E-66
aggttacaggttactgttgctttctgaaaatgaatttcgtatcaaaccttgtgaggaatactttcttacatacaataaaggttcagttaggtactgttcgattagccagtaaaaaagcaaagggaagtactaggaatactagtccaaaagtgagacctaagcatagaggttggaaagtccaagatggtcattatgtacacccagggcacattctagtcctacaacgtcatttacgctttcacccgggactaaatgttggtctaggtagaaatggtacgctattcgctctcacgcatggaagagtagcagttacatgtgaaaaaacgaatccagattggacccatacatgggtgcaaagatgccatggccatcgaaaaggcacagattttttcaagaagtatttcaacattataccagagccgcaacatcaaaatttcaaacttgttgatcagatctgataacattactttgtttcataaatgtattgataattggtggattttatcaacaggcttgtactcttcaccacttgaggaatatgaagcaacaatattcaccactattttaatgtacaaagaatatgtcactgataaactgttattaaatacatg

SEQ ID NO: 303 - DNA, 3328 bp, Leptinotarsa decemlineata
  Annotation=N(6)-adenine-specific DNA methyltransferase 2; Tribolium gene name from OrthoDB database=TC004409; Blast E- value Tribolium Gene vs. Leptinotarsa Unigene=2E-95
tctctacctgtaatcagattcataataatcttaatctacattttaccgatataagtcagagctaaagctaggctacaatctaattttgctatgctatttctgtgatgtcttcaaacgtaagtgacgacgaggatgttccacagttatcagcagaaacgttcgctgttttgcaagaattttataaagaacaggaagaacgcgaaagcaacttggtattagatacggacccgaacgcttctctggaggaagattggcaactcagtcagttttggtatgacgatcacacgatagatgtattagtagatgtagctttgaaatcggttggtgataatggaaagatagctttagtttcttgcccgacactgtacaagaaaatgcgaaggaaagctagagagaattgtgaaattactttattcgagtatgacaagaggttttccgtatacggcaaagacttcatattctatgactacaaatccccactagatgttccaagagataagtctgattactacgatttagttattgcggatcccccatttctgtctgatgaatgtctgacaaaaactgctgttaccatcagatttttaacgaaagacaagataatattgtgcaccggtgctgtaatggcagacatggccaaaaggttgctggacctgcagaaaagttcttttgagccgagacacaagaataatttggccaatgagttttggtgctactcgaacttcaacttggacgaactactgtgatgaataaatgaaaaaactctcgttttgttcaagttttattgatatgtttgcatgaaatgtacttgttataaaaaatcgtaacgaagcagatgcaggttatctgcggatcaaaatccgaattattagaataacagtcataaaagtaacgaaaaatctcggcaacatatataacgagtggtaaagctaatataaataatcaatgtactttgttagacaaatatatatgccttcagcaggaacgaaataaattgttaaaacattcgcaaattaccacaaatgaacctgaattctgcgcaattccacaccaggttctttggagattcacgtcctcgcagatctctagtaactagaaacattaaaggccccactatagaagcaatatcttggtcccaccatttttttgcttctccaaacacctgtaattgctaaaaaaatcttcaaagggactattatttttacaaaactttctaaactaatatttagattatctacgtcaacttatttatttgatttcttttgacgattcaaccacaacctttctgggtggaacatgtccctttataaccattctggcttaaataatgaaggttatacaaattcagccctgatgtatctaattgatatcactatacaaatagtttcggtacttgcaattttgaatatctttgtagaatactatctggagcaatttgttttttcgctgacagcagaccaagaatacttcaactatttaatataatcacaattcatctaaaacagcaatattctatcacttaaatacaatattacattctgcaatataacaaccaggagcctgcttattacattaacgaatatccttaaacagccaagacacttcatactccccgtaatatctagccattcatcaatccttcgtttctcgttaataaaaatgatagtacagtcttatacattttggaataagtaatatgtagtttgccagtcgtctggtgatattttggcttatatacaaacactacattctgccagacaattcacgacagtgctaaaaaaatgtagtatgcctctgagaaaaaagagtattcaatttttcaaaatattccccattcattctgtcatatagattcttggtaaaggttataatgttcacgcttcaccattgccttgatttcaacaagttaaaaaagtaaaaggcataatgaatgtaaattcagaagctgaataatcagctccactccataattgtactattcaatgttatattagatcacatgttgcaaaaatacagtaagaatcattaaactataaataaataagtaaagactgacttccaagtcactttaaactgttaaaaaacaaagattagtatttggtgtcaggtgtgggattcccgcaattaacattttcttatattgaatcatgattctttggcgatatttcgtttcccctttcagtgcttgagttaccattcaatctcaacatcagttccatctgctaccacacaactgacctctagtcccagacaggaacgaataaaaaaccaaatgtgagtgaaccgcgacataccaaccaaaatcttgttcgagcagctcgtttcgaatcagctgaacaactcttgacccgtttcttccagtgttttgtttgttaatctttctatctcgcaaagcaggaactgagtatcggtgtcgacctctgacaaaggtggacttgcgtgtatggagttgtgaacgttgtcccattccagagagttatccgaagaagacacccgggaccagtcagactcactaggaggggcagcgctggcagaatggcgggggctcgaattgctggggcacagagatacatcttcgggaagttgagtccatgaacttcctgaagcatcatgaatcatggatatgggtagagtttcgtgttcccattctagatcaagagaactggcaggcgttgatgttgtagttcgttgtaacaaagcacgagcatccagacactggagttgtatatcacgactagtacatgacccagacgatggattcctctgtgattcagatagtctactgtaggctgacacttgtgggttcaacaggctgtcaactaattgtagcacaggtttctttttcttagtccgttttttgaaaagacgcgataataggcctctactgcttttattttcctcagcataaggggagttctcatcgacgagaaaagaaaaatcaaccgcgctgttttcattgtcgagtatactaaagttttgaaaggctttcacagctctactctccggtagacaagtttggaagcaattgcccatcgctgctgcagccctgtggggactgcacacgcttcaacccccatagggccgcgatgaatccgaagactccgtcttggggaactaattagctatttctttcgcccaaatcgttgcctatccggtttgatgctcgtcagttggcaagtccgaaaatgtgtcgcgaagtggggtagtgattcatgaaaggtttgagccaaatcaaatgggaacagaggagacaatgtcaaagtttttcgaaagtacaaaatgaaagttgaaaatatctctacaattcagatcttatctgtcatatcct

SEQ ID NO: 304 - DNA, 2851 bp, Leptinotarsa decemlineata
  Annotation=Ubiquitin specific protease (Fragment); Tribolium gene name from OrthoDB database=TC004831; Blast E-value Tribolium Gene vs. Leptinotarsa Unigene=3E-17
aaataacggcttttattcaaaaacaaactatattaacttgcgagacacactcctccctaaacgggccaagaaatgaatcacaaacagaaactaaagtgagttgaaaacagtctaataccaactcccaacatatcacataagagtcgaacattctaaatacagctatacaaataatagttgaccagttgtgttcctcacgccacgcgaatccggaccatagaaaagccaacaagtgaaccttatataaaatatatttataagtataaatattgtagagttacagttgaatttcaaacacatctctccctatatacaccactctttcggtcgctagcacacaaacatattacccgacgaggccgaaaacccgcctccgccgcaccccggtgggggaggttcgtcgtttttgtcctggttaatactgtacaacttcacagacctacgttccctatcccgtttgaattcggcgttgtctttacccaaaactagttgtaacctaggagggagcactgcggccggcaggtcctccatatctgaaacgtcctccctactgtagaatagtatataaggagtctccggcggctttaaccgactcaaacactccggcgcagctttcgtcaccgagtaatcgttgaatttgaaccaattcgacttgtctttggctagcgtgtagtagtgtcccgagtccaaactagagccgcaatgcactacaacagcgtacagctcgtaacggcagttatccaaggtgaggtgctcgtccaaagcgaccgtctggagcaacttggtgcgctggtgggaagccgggtcgtagtgaaagtgcttcagcgtcagcgtcaatctagtcggaggctccattatcctcgttatcctctcgctgtcggtcaaccgactgcactgctcgcaatggtatttgttatcgtccgttaacttttcaggctgcaggtagtattccaggagggtttgtactgtttggttttcgtcgcggttggggaaggacagctgcagatccctgaaattgtcgatacgctcgctctgtgttccgcactctccgcatcgtgagacagtcagcgtcttgccgccgaaagactgctgcactacggtaggtgtgactgctgcggcaccttcatcttccgaagcactcgtcattttgatgaaattgttctcctgctcgtgcaacgtatccagcaggaaccctaaaaactccgagctatcatgctgttggccggcaatgaagcctggaggccttgccagatccaaaatatcgttcggcgatagggctgccctattcgaaaactgcagcaaggcgaacagctcttgcagtttgatgaacaactgcgaaatgtcattgttacataacagcacctcgtttcggaaagtcttcgtcatgaacagcgcctgaaggacgctgttcatgtagcaggtatttcccagattggtcaggccgactttttcgacgaaatacttattctgcacatacgaacccgatgcgtcctcccacgatttgcagcgcaacacttgcttgcagtccgagtcggcgaagcggggtagaagtacgtcggtgagaggttggtatagttctgggtaatcaggaaaatggttcatcaacgccatgagcaggttacccatttcgtatagacaattcatgcttgattctgatccctctttttccaatgcttgaaaaacggtactggcaagcgggatgattttgtgaaacacctgaggattattctggtttctggacaacatatagagcacaatgggccccactgctttccttatcttgtgaaacatcaggagcttgaagagaggttcaatctcggctaaggcgacatcaatcaggatctcgtaatgttgttccgcttccaacccttccataaacgccaacaccagcggccccaaattctcggcccaagcacacttcttcaaccaattacaaagtgtgtggatcgccctttccaggttctgttccggataaccagcccccaatatatatttgaccgcatgagggatgctcctctgatcgatcaactgcaaaacaattgacatggctggtgaaggctgcctttcggggtccggattggagatctcgtcgtacaaagccttcagtgcgatgaaagtgtgcttcttgttgcagaactccttggctaggatgtctctcaccttcgttatgtcctcgatgaatttcatgtagctgactgcattgctgggaatcggtacgctgcccagactcttgacaatctggacgcatatcttgtcttgcagcccgtcttgcgcggatatgccctccagggctctgaggattatttgcaagcgggcctcctgcgcttgaccgacacattctatgactttctgtttgacagccatttcgctacttcagagtagaaaagttgatctcctttgggttgacaaggttgatgatgagtaaaatcggcaagcaattccttattgagcgaatacgaaaacaaataacagcagatgatccgtgactcaaatgaaactgttctaaaaataacgatcaaacttttgacatcaattaattgccattgtttgaaaatagagtacggttacgtaaatttctagacactattcaatgcaccttttgtattaatattttggaaactgtttaaagttgggataaccctaccgttgtggtgattttctagaataaatacgtcactggtgaaaattggtctcgaataactaatacatttgtgttgttttctagctgtggctgaactattcgaaatagaaataaattggtgatcactgggttgataaacaaaacttaataaatctgccaaaactaataaaatgaatttatatttctttgacgtgaggtacctgtcacctc

SEQ ID NO: 305 - DNA, 2263 bp, Leptinotarsa decemlineata
  Annotation=Dymeclin; Tribolium gene name from OrthoDB database= TC008664; Blast E-value Tribolium Gene vs. Leptinotarsa Unigene= 0
gaagacgaagcggttacgtgtacaggttagacgatgtaactttattttcaaattctttttgggtttttcaaaatttagatatcgacaaaacattggaactcaacggaaatatcaaaaaatgggtcaggccgttagcagaagctttgacatttcttccaatgaatactgtttaagattcataggaaaagaaaccatagtagccaatgatcccttctggaatcgttttttagccttcaatatcaccccaccaatgacaataaacgaacagctagctatcgaatcaaaaatcgaacctttatgtcaggagctgttgaagaataatttgagttctggaaacttcaattcccttattcaatgtttcctcacaaagtcaactgagttattatcagctacaaattctaatgcggagctttttaactggcaacttttcaacaccatctttacgatacgttgcgttttaaagttcatgactgaaattcttcctgaagaagaactgatgaaacatattgagtttaagggaagtgggaactatgtagagtcctttattggcacattggtgggcataatagtagatgtaccagtcgaagactcgacttatctcattcatttggaagctttgacttgtttattggtgtgcctgtctgttcagtttcactctggtggcagatcagatcaaagtatgatatacagactcatcatgagaggcaagcatgttatacatgccccggttttggtgaaaagtttgctgacaaattttatcagccaagggaagttaccccctggatatggtgggaatcatggccacagcatagtactaggtttggcttcagatttgtggtctttgctgactttcagtaaaaaatcaactgaggaagtggtttctcccgaattgaatgatttccagcaagcccctctagctagtcaaagtttattgctacttcttgtattagtgcatcattggacaacaacttcaaatccatacaggaacagtttgttttcctgtttagatagtcaagataccaatccagtacctcctaccaaagcatcatctttgttcaaaatagatttcaacttattgttcctgacgttatgtgagaaagtgacaggagacgctgcaactttgcttttgtatttgttgctgcatcgaaaccaatcatttaaatcattcctactgagaagagcagacttagatcaattgattgtaccaatcctgaagaccctgtataatgctccaaatagcaattctcatcatatatacatgtctctgatcatattgctcataatgagtgaagatgacagctttaatactaatatccatgatttgaaacttaaaaccgtcgactggtacacggagagagctttgacagaaatttccttgggaggcctgcttatactagtcatcctacgaacagttcaatacaacatgctcaaaatgcgagacaagtacctacatacaaactgcctagccgccctggctaacatgtcatcacagttccgcaacctgcacccgtacgttagccaacggctgatatctctgttagaaaccctagccaaaaaataccacagacttatcgagcttgcaaagactgaaaaagaacgcgaagactctgaagtcgtcgtatctgtgaaggactctgctgacgtcgaacaggaccttacggtgctagaggaggtcttgcggatggtattggagattctcaactcgtgcttatcgacgcagctggccaacaatcctaacctcatttacacgtttctgtataacaggcacacattcgagttgttcaagaacgatgtcgtgttccaggacattatacataacttggatattatcattaagtatttttctgaattgctgcatgataagtccagagagcacgaagtcgatgcccatcaggtgctgttggtaattcagcaaggtgctaggaactggccaaaggataaattaacgaaatttcctgatctcaagttcaaatacgttgaggaagaccaacccgaagacttcttcattccttacgtgtgggcccttgttggtcagcagtcagttttgaattggtctaatgactcattgtcagttttaacaagtatttgctaacaattccaaaaataacatgatataaataatgtatatatgttaaataaattttaatttatagttacttgtaattataatacccagaaatatttataacaaaattgttgatatgtattattaatttttaataaaagtatgtttttttactaaaaaaaaaaaaaaaaaaaaaaa

SEQ ID NO: 306 - DNA, 1034 bp, Leptinotarsa decemlineata
  Annotation=Ribulose-phosphate 3-epimerase; Tribolium gene name from OrthoDB database=TC011438; Blast E-value Tribolium Gene vs. Leptinotarsa Unigene=1E-14; Blast E-value Tribolium Gene vs. Leptinotarsa Unigene=0
gaagaaatcagggggatttttttatttgtaggttagtaaaaaaagaaaaattcaagaatggagagatcatctttgaaatgtaaaattggaccgtcaattctaaacgcagatttgtcacaattatatgtagagtcacaaaaattaatagacaacggtgcggattacctccatttggacgttatggatggtacttttgttcctaacctaacatttggacacccagttgttaaatgcttgagaaaaaaaatacagaatgccttttttgaaacacacatgatggttcaagatccagaaaaatggattgaacccatggctgatgcgaatgtcaatcaatatacgtttcatatagaaccagttttacagaatgtgctgaaagtttgtagaaaagttagagaagcaggaatgaaagtgggattagcattgaaacctgatacaggtatagaagctgtaagacaatatatcgatcacgcagacatgatactagttatgactgtcgaacctggatttggtggacaaaaattcatgggagaaatgatgcctaaagtacaatggttgcgacgtaattatcctctattagatatagaagtggatggcggagttggccttaatactataacttcttgtgcagaggcaggagcgaacatgattgtgtcagggacagcaataataaactcggtagaccagagagctgtaatggcaagtctgagagaaacagtcgaaagctcaattcacaaatgcaatgtttaaagtctgtgccaatgtgattcaagttaagttttatcagaattcaattgttaacaaaatcattcctcaagaacatttatcaaagttgttgctgttgatatttcaaagtcagtttttatttgattaatcaatcaatttcctatacaaggaatcacttgtttgaatacctaagattttttaattgttgttactgggaaattatttttttatattatttacaatacctgctaatcttgcagtggtatgtaatgtaaggaagttctatttcaaaataaagccttgttttattc

SEQ ID NO: 307 - DNA, 2018 bp, Leptinotarsa decemlineata
  Annotation=cyclin-dependent kinase 10 isoform 1; Tribolium gene name from OrthoDB database=TC003488; Blast E-value Tribolium Gene vs. Leptinotarsa Unigene=0
gttcattaaccacttgacgaaatttttaggttgacagtaatcacctcgaaattttcaactgttcatagttgcttttctgtcgttctgtgttgagtgtcacttctgtagtaagggtattctgtggttttgtggttagtgttgaggttgggtgaatactgaatattatttgttagtttggagatgagttttgggaaatttgtgatttgaattgatgtgattagtgtacgattcacattattgttttcactatgagtgtggatcataaaaaatctcctataatgactaaagagtttgatgagggttcagagcctacagcagcagtaaataaaaagggtgtcctcacttcattcttaactggtaaaattatgaatataccagaatcggacatgttgggaagatgcaggtttgtttctgaatttgaaaaactcaacagaattggtgaaggaacctatggtgtagtgtatcgggcaaaggatactgcgactgacaaaatagttgctctgaaaaaactacggatggagggagagcatgatggaatacctgttagcagtttacgagaaatacaagttttgctaaattgtaaacatgaaaatatcgtctttctcaaagaagttgtggttggtcgaagtttggagagtatttttttggctatggaatactgcgaacaagacttggcatcacttttggacaatatgcaggcccctttcacagaatcccaagtcaaatgtatcatgttacaagttttacgtggattacgatatttgcaccataatttcgttgttcatagagaccttaaagtatcgaatttactgatgactgataaaggatgtgtaaaaattgccgattttggcctggcgaggtggtttggggtgcctctgaagccgatgactcctcgtgtagtcacattatggtacagagcaccggaattgttgttacaggctcccactcaaacaacaagtgttgatatgtgggcagcaggctgtattttgggagaacttttaggacacaagcctcttttaccagggcgatcagaaatacagcaacttgagcttattgtagatttgcttggtactccatcagacgcaatatggcctggcttcagcgatcttccagcactccagaactactcactgaaacaacagccttacaacaatttgaaacagaggttcccttggctttctgctgctggtctccgtctattgaacttcttgttcatgtatgatccaaggaaaagagcaactgctgaggaatgtttacagagtagttatttcaaagaacctccacaaccgtgtgatcccaaattgatgccaacctttcctcaacatagaaacattaagggaagcaaaacgaataatgcagagtctgctaataccggagctggggaccaaacaaacaacttgccagctatatcagatctgttgggttcgatagtgaagaagagaagactcgaatgatctttactgagttacaattccactgagtctacaaagaagaaaaggattaaataatccaaggaattttattgcatttttgtattgaactttattattcacttgtggcattattgtgatttatccaaacaaattcaagctgcaaacactagtcatgaaattgacagataatgaaagtgatgttaaaggtgaacatttcaactgaagaaaacatatttgatggtattttaaagttgaaaatatttttttatcattgactttggaaatgtgcaaattcaaactagtgggctcattttcaatataatttatttgcaaaagttttcttgtaaatttagataaattataacttaattttcttgtcaataataaaaaaatatgattctgtctgttgaaagtgtttgtagcctgaattttttaaaccaccaattataagctagaaatgtttctcaaatttgtagatgttcatcttttcatgtagattttgtgatattcacaaagtaaaaataaaatgagtttcaataaataaaaaaaaaaaaaaaaaaaagtaactactagacgttgaataac

SEQ ID NO: 308 - DNA, 663 bp, Leptinotarsa decemlineata
  Annotation=SH2B adapter protein 2; Tribolium gene name from OrthoDB database=TC015430; Blast E-value Tribolium Gene vs. Leptinotarsa Unigene=8E-43
cttaggaggtgagtagaattctagcatgtaccctccagtggctttcactagttgtaacctacatctttcccatctaggtggtccactaggctgatccaaggtctcaggtgttgaatacgttgacaattccctcctttctacattccactacaatctttgctaatttggttttattgtgtgctatatctacatcatcagaatgttgcttatggaagagatctttactttttcgtaatactttaaagctgagccttctgaaaaatggcttgtggggcattttttggagagccttcttcattatcttgtatttcagtttcatttcttgtgccaagaccatttgaaatttttgtgttgttcattcttcttctattgaagtccatttcaaattgttcagtgaaagactccatgtaatttttcaagaattctttgtgagtaatagtagacttaatagactcaggtaaattcatgttcatgtactgcatacaacttttcgaaaaatcttgagctgctgcttgtgcatgtctttcacaaaaatctatccaagcaccgtctgttgtggtggactcgaaagcggttgccattttatctattaccagtcaatagtaatatcaattgattaatccatttttatttcataaattgcttccaaaatctattgttttc

SEQ ID NO: 309 - DNA, 2586 bp, Leptinotarsa decemlineata
  Annotation=Vesicle docking protein P115; Tribolium gene name from OrthoDB database=TC006352; Blast E-value Tribolium Gene vs. Leptinotarsa Unigene=0
aataataggagatatgataatatttcattattactaattaatgtttactcaaaaacaaaattgaataaaaaatggtttgaaaagatagaaatggactactttaggagtggattgaaatcggtcctgggggcttcgcctcctggcacccagccgacaggccctgaaacagtagaaagactcgtcagtagggtaagcacatcaactttacttgaagatagacgtgatgcttgcagagcccttaaagccctctctaaaaaatatagacttgaggtcggtgcacaaggactggatgttttgaagcaggttttggaattggatcatagtgattttgaaactgtaggttattgtttggataccttatgtaatataacgtcaaaggaaatatttgaagaagaaaatgagtcgatgaatatgcaagtgaatgtaggggaacagtttacggagatgtttttgaaaaattcagaaaatgttgcactagttttgaggttcttggaggaatatgattttagagtacggtggcctgcagttaaactactgaattctctcacgttatcaaaaccgaaagaaatacaggatataattttggtttgtccgatggctgtttcaaagttgatggatttattattagaaaatcgtgaagtcataagaaatgatgctctagttttacttatcaatttaaccaggtccaacgctaatatacaaaaaatagttgcatttgaaaatgcttttgacagattgtttgatgtaataaaaaatgagggttggactgatggaggaatagtagtggaagactgttttcttcttttgttgaatcttctaaagaacaatgctagtaatataaacttcttcaaggaaggttcctatattcagaaacttgctccaatgttcaatttacctccaaatttagaagaagtgggttggagcccccaaaaaatttccaattttcatagtgttctgtggttggtgcgagccttggtttcacctaataatccagcacaaataattactgcatgtcagaaagatatgcgtaatacaaatttattggagtctttgtgtgatattttgatggctagtggagtaccagcagacattctaacagaaactataaatactgttggggaagtgattcgaggaaacctaaccaaccaggagtatttctcaaatgtattggctccttcaaatccgcctagaccagcaattgtagtcctgttgatgtcaatggtgaatgaaaagcaacctttcacattgagatgtgccgtattatattgtttccagtgttttttattcaaaaacgagattggtcaagaacttgtcgttcaaacattgctacccagtaatactggatctggagctctcactacaggacaattgttatgcagtggtttgttcaacaatgatcacttgagtaattggttttcagctgtagctctctcacactgtttaatagacaatccagcacaaaaagaacagttactgagggtcctcttggctacaaatttgggagcacaacctgttagccttctccatcagtgtggtgtatttttacagcacaccagcaacctgcaggccaaaataggaatactaatgttgattgctaactggatggcatattctcctcaagctgttaaagtattattgaatgtttctggtgcgatggcttatttgacagcacaagcgtcagcaagcgaatatgacaataatgaagaaattttgcagggtctttgtgcatttgtaatgggtctttgtgttgctttcaatgacaactccgttcaaaattactcaaaagaaaatttgagccaactcattgaaaaacgagttggaattgaaacgtattgtaaaaaattatctgaaatttcccgtcatgaagtttatgccaaagcagcgaaacaacctcaaatcagagccaaccattccagtgaattattattagaattcgagttttgtaaattattcaaagcattagagggtgttattatccagtctttgggagcacagagagatttgtccaatggaatttcggaacttagtttgaatgatcatgaaaatgccttgcttctacaatacaaggaactgataagagatcaagacaaaaaaattcaagaactccaaaaaaacatcaacaacttgaccaaacagaatgaggatttgcaggaacgaattcaagaattggaagaaaccaacaggcaatcggcagatcagaatactcttctgaaagctcaacttgctattagttcaacaaattctgtaaatatggtaccacagttggaacaagatcatgtcaaatccaatctaacccattctgtccctgatactagcgagtatacagatttgctgaataaaatcaaagcattggaagcggagaatttagagaaagatgctgagttggacaaaatcaggaaagaccaggatgatttacttgaattgttaacagaccaagatacgaaactgaatacatttaaaaataaattagcgagaattaggtcagacaaccaatgatgaagattctgacaataactctgcctattcagaaaatgatgaataaatagtaattattttcagacattcagagtgttattgatctataaa

SEQ ID NO: 310 - DNA, 344 bp, Leptinotarsa decemlineata
  Annotation=Transcription initiation factor TFIID subunit 8; Tribolium gene name from OrthoDB database=TC009938; Blast E- value Tribolium Gene vs. Leptinotarsa Unigene=8E-37
gttctaacgcaggcgtgaggatcgggaaactgaggcaagtactgtggaatgtgtgggggcaatggttgtttcgtaccagccgggagcatactgagttgtttctgtggctgttgctgttgcaaggaaggtaaaacagaatgttttccattcttatagtagttttccagggtattgaagttgaaacccatttcaacaaaacccaggataacgtctgcaagtatgggttccactctacctgccaattcgcagtagcttttgctcatggctccgatctctgccaggaaagcttgtaacatttcggtaaagtttccaaggcagctttgtcggccaaatcgcatccgtgt

SEQ ID NO: 311 - DNA, 1258 bp, Leptinotarsa decemlineata
  Annotation=Calmodulin; Tribolium gene name from OrthoDB database=TC015439; Blast E-value Tribolium Gene vs. Leptinotarsa Unigene=8E-136
gttatatataggtagttagtttaaaatttctctataatatacaatttcaatttagacacaaggcaattatatcaatatgcttaacaaatacacatatatgaaaatttatcatagctgacaagctgaggacgaaaaggaatgctttgattttgttcttctttactatcgataagatgatattccaaaaagtttgcatttgttttttcttcagtatcccattatttcttcatcttcttcatcgtagctgtcgtcatttccaggttcaccaagagcatttacaaattcataaaagtcaatcctaccatccccatcaacgtcaacctctttgatcatgtcctcaatctcttcttcagacaggtcttctcccagacactgcagcacagctctcaaatcagaagcggtgatgtagcccctgttgtgcttgtcgaaaaccctgaaggcgtctctgagctccttgtcttcttcttctctagactgtacgtggtcaggatctgtaccagcgctagcagaccatgcgatgtctacaaactcctcgaagctgacgttaccgtcaccatctatatccacttcttgtaacatctgctgcagctcttcagtgcgagcaaactgtcctagagacctcatcacacgccctagctcctctttcgtaatgctgccgtcgccatctttgtcgaaaagtctgaatgcttcgcgaaattctttcatctgacttttggagactgaagagtgtcttatggaaaagctttggttccttccataatctgcaggcctaggatcttctgtgatagatctttcttcggtttcattctggaacgttatgttcccgttcgatggcacttcagcttgactcgtctgacgagtcatcaggtccttgatttggctcacgaggggtgagctggaaaaaaaattgttcaccgcggaaaacaatttgccctcgaatttcgccacgtttcgacagttctggaacccggctggaatactattaattcaactttctggtaaacactgcagaggtgtgtcgattttcatcccttccacgatctttcccggtttttccagattttccgaattattgaaaatgatgtcgcattggagagaaatccgcgatatttttacgagattctgctattctcaaggtggatgtttcgccgtggttatggtttgccataaattgataccttggaaatttcagaggacagggttggcctcgctatagttcccaatgcacagtgtcttcttgagaaatatacatacactc

SEQ ID NO: 312 - DNA, 1916 bp, Leptinotarsa decemlineata
  Annotation=Myosin-2 heavy chain, non muscle; Tribolium gene name from OrthoDB database=TC008094; Blast E-value Tribolium Gene vs. Leptinotarsa Unigene=0
ttgtgtgtgctagtcttacagactgaatggattaattcgtgaaatatgcccagaaacgaaacggtgagatcccactgcccgaaggatgggatttcggtcgggactacgatggaaaagtgtattttatagaccatattacgaaaaaaacgacgtggattgacccgagagacagatatacgaaacctcaaacgtttgccgattgcataggaaacgaattacctttaggctgggaggaggcgtttgacggacaaataggaccttattacatagaccacgttaaccaatcaactcaattggaggaccctaggcaagaatggcgggccattcaagaagctatgctacgagaatacctcataaccgctcaagatgttctagaagcaaagaaggatatttatcaaataaaatcacaaaggctgattttagcccaggatgagtatgatcatctcaacaatgcactcgcgactctaactacatcgagaacgagtttatgttcgtccaatagtaatgttagcacaaaatacgatcctgatcttctcaaatcggatgtcgctttggcgaaaaatagggtttcgaggcttaagagcgaattggaacaaatacggaacgagatgacttatactcaaagaggagttgaaaccttaacaaacgtggaacaaaaactcagcatgcaccaaggcacatgctacaacatatcagaggctcaagcgatcatggctgaactgagaaacatacaaaaatcactatcatccggcgaaaaggaaaaagcagatctgatgcaatctttagcaaaactcaaagatgatctcaccaggttgcagctatcagagagctcccccgatatatcgacattgagtttgccccaagaaaaactgagcaccgcctcacagacagacctttcctgtgaattggttcctatcggaacgaggctagcagaaatggcaaaaatgaggttggaatatgatgaagcaaggaaacgagtacaacacatccagcaaaaactagcagatctggaggaaaaagtgcatccaggtcaagtggaatccgataaggataggctgctgctattccaggaaaaggaacagctactaagggagttgaggagcatcgctcctcgaatgcggtccaaagaggagatgaacgggattcaattagaatgcaagaggctggaagaagatctgaacaaggcattggagatgtcgaatagggccatcgccgaccgattgagacttcatgaagaaaagcagtttttgctgcagcagttgaaggacggtctaaggcaaatgacacaattggagtcgcaattgaagacgctttctgctagcactctctctgtgagcagcagttcaagcctcggttcattgtccactacgagcagtaagggatctctaagctcaggtttgagcttcacggatatttacggaggtcctcaatgtatcggatcgtctaatttggagaaacctatagatatggcggatttacataagagggtcgagaggctgttgatgaacagcgacagcataacgcatacttcatctcccaacagatcgcaaccatcattgtcacctagaagttcgttgtcctcagtttcacccccagtgtcgcccatgtatgagaatcttccaggtctgataccacctcctacctacgaacaagtaaaaagagaaaggcggttacagtgtgatcaaaaacagattgatgaaaggcttgttgagctcaggctttccaatacgtccagtaccgaataccttcataattatgtgtcgcaacgtggctctatcccgagcatatctccgctgacggatctgctagaggcgcaaacgagtaacatgtcccaaggttcaggactgggcaggccctgcaggtactcttacgagagctcaggagatccaccactctcgcccatatccgagacttcg

SEQ ID NO: 313 - DNA, 1219 bp, Leptinotarsa decemlineata
  Annotation=CG4289; Tribolium gene name from OrthoDB database= TC012572; Blast E-value Tribolium Gene vs. Leptinotarsa Unigene= 3E-69
ctaataacaaaatagtttattgcgttcccaaaaaatatattcaacaaacatattcgtggtatatattttttagaatatacaataaataaaaacttgtaaaatctcaacacacgatgtggtaactaaaaataaaagtcatgtcgtaccaatatgtaaaaaagtattgtaaatttacataaacatcctaatctttgtcgatatcatctttgttgctttttctactgtggcaagattctgaatcacagtccctcgaatatatgatctccaaactggattcgcttgtcttcatgccgtgctctggttcagacgatccggatccagaccccaagtcttctagcaagtcttccttccttccttcagggtcaacatcttgctcgtcgttgttgtcgggagctacgctagacatttgccatgcaggtatcgacggtgggacaactggaatattagccactgaagggaactgttttctgctcagcagaagtcccttcacactggagatttcggatttcagatcattgaattgcctacttgtaacttcctccgtatttctttttcctatttcaactttcacactttccagctcatctttcaactggccaacagttgatttcacatttttatctaattcttctatagactcctcaatagacttctttcttttaccgaataaaaatggagcgatatacctcatataaaacttgtgaataagataagcagcaatgctgaatagcgcaacgttttgtatcacatcccttatcctactgaaaatgcttagttgggtttgattcctataaaaatgattgctagcagggctcggcgtgagtggtaggggtggcggaagacgattctgttcctcgtagcgctcgtaggaccccgatttttcacaagccagttgaatttctttgtcggtcaggcctttgcgttggagaaacttttgcttctgagccaacggggtgtttatcacgttgggattttggaggaattttattgctgtctggaccatttcatcgcgaactggagggatatcaacaggtgattcttctgggctggaatccattactgaggcattcagtgatagtacagttcaaatcacactttcaaattacttatcaaagtccgattagaataatgtgattataaagtcaactttgaacattataatgctaaaataacagcaacctgcaatacatgcactaccttcacagtttttttagttgtc

SEQ ID NO: 314 - DNA, 2349 bp, Leptinotarsa decemlineata
  Annotation=Ubiquitin carboxyl-terminal hydrolase 1; Tribolium gene name from OrthoDB database=TC004831; Blast E-value Tribolium Gene vs. Leptinotarsa Unigene=0
ggaatatttctattttcatacatcatagcgattcataaacaattcaatataaaaagcatctttctagagtaattcacacttcttcaaactaatcctgaattgatttaagctctccatactcgaatttatgggggaatgtgtgcacgatttattttttcaaaaagtaaatacaaatatgtcgagtttttcaacgatcatgaagtcaatataaatatttcgtgatatcacataaaatcaagagcatttgtactcacttaaaaaaatattaaacaatgttacccttctcattcgtttagttaccgttaccctgataattggtcagtagatttggcatagaacagcaagtatggggtcgacgtcgaatttggcttgtaacttaattcttctacgagttcttggctagtgattggcctaacgttttcgtcgtcacattctaaccacatgtcttccggagccacattgttagaatgccaaggaaattcctgctcgtctttcctggaacaactgttgaaagcgttctcaacgacattcttgttcaatctcacaccgcaacaatccacacccctgcacatcctaactccgttcaggacgcttttggaggacagtccgtttctactatcaatcaaggaactggcatgggaccgcggcttcaggaacttcaggatgttcagagatttttcgctgctgctggcggaaagactgcccttcggcaggtctctcgagcaatcggaataatcttccaagtggtcggaagctttgacgtatgcgatgtagtgtccagaggccatcgtaccccccagatgcataatcacacagcacaacttataccggtgagaagccccagtcccctccaccttacaacaagactcgcagaaacatttcaaagagagtggagtaggtaggtaagtattcactttctggacacctgacgatgacgtggtgaatctcttcaactgcaggaccattatattgggcaacttctcgaataatacctctctggatgcctcgttatatcgcttacatttctcgcacaagtatttgttagaatcacaaagtttttcagtcgttacacaagcccttcgaaaaatatcatttacattcatagaatcggagtcatcgtctttcacggatatcggtacgggaatatcatagaaaggttctttcctttctgaaacgctttcacattccaagcacttggtgcgcctcaacgttatcccctcgaagtcctcggcaacgaaattgtatcccagtttctttcggctgcccccgctgttgctatcaatcgaagctgagtcttcgatgtcagtggaatttgtcccgttcacctgctcctcagatatgggctctttggtgctcttatctttcttcttgtaatttttttttccaggaacgcctcacgttccaaattctgctggagttgacgggagctgcagactcggtttcattgagaagttccggattttgctcgacttgctgcgttagaacatcacaagtttcacgaatattatccaaaaggtaaacgagcagttcatgggcatcttgttgattgttaccttcaaatattgaattagcttctctaacagcttgcaacagagcgatcggttggtagggatcagtggagtctttcagttcaagattgtgcatcgttgtgaacaactcatgcagtttctctgtgacaatttgcacttttgatttcgggatgatatcgtttgaacttcctagggacaataaatccttgctgctagtgctgcgcgagctcgggcctgtaatagctcctatatttcgaccgagagacgaggttttcgctttggtctgatttaatcttgaactaaccagagtcaaatctccaatgaggtgatgcaggttatgtaagaatgtaggagcaaaacgcagagtatacagaacactgtttagaaagcaagtattgcccatattcgaaagagttgctacaggagagtcttggagaacatctccgttgtttttctggtcgccccgatatccgttcagcatttcgtccaaggcctgttttttgttagatatagtgccttcctcaaatacgtttttgcgtttcaattgatgaccagccttatactttttctttaagggttgcttattgcgcatagaaatcacgtcattctccagaattgtcatcttcctcagtattcatgtgtattcaatattgaaactatcccaccacacgaatcacaatttcactgtcatccgtcaggaatgaaaatgtatttgaaaatctcaaaatcaaatacttcgtaaattcctacagtatacaatatatactatcaaatattatccattaaaggtaggactgtagattaaataggaagacaaatc

SEQ ID NO: 315 - DNA, 1937 bp, Leptinotarsa decemlineata
  misc_feature (39)..(39): n is a, c, g, or t
  Annotation=Patched protein-like protein (Fragment); Tribolium gene name from OrthoDB database=TC010878; Blast E-value Tribolium Gene vs. Leptinotarsa Unigene=3E-11; Blast E-value Tribolium Gene vs. Leptinotarsa Unigene=0
ggacatacaacagctattctgtgctcacactcagtttcnctttgtaaatcatgaattcagttcactgataaccaccattttcattgtatcaggtgcagttttcaattctcagtcatccaatcttctactctgttgaagaattcgttcatttgttcgtaagacattgagtaactataattactatcatattctactataacagcttttattgtcggagtttggtctatttgaaaatttcggacctgccataccaggacttagtaggtctattggggtttcataaatatcagctatttcatcaataatgcattcattgaatacacttctgttgaatggaaacttggatgttttacaacatggagatctatctttacttgtgaacgagtcataacatttccgttccattgatttcataaacgtctctataaaacagtttggtagtagaggccccagcatagattgataaaagggttgttgtctgagtttttgacagaaatttagaagccattcttgggattctggttcagacacgtcgaatgttggatcaagcgttaggctacctaagtttgaaggatccaaatgatcaccattatctataggaagtactccccatacaaatctcaatggaagtttgtagcttgcttgctctaacttctcagggcggttaaaccagaagtgtgttttatatctgaaatcgtattgctcaaatggatgtgatgttgcaaataactgaaattcatttgtatttggtaaatgaagtttcggataaaccaatactataaaaccactcatgattgctatcgtgaatagtagtagaaaccaaacaaatttgaatcgtatcacaaaatccagtagccacttctctttggctttccaaaatctttgaaaaaataaacactggcaccatcctgcagacaaattccattgaggcttgatgcagcaccatctttggtaacaaaccatgaaacaactccgaaaaaacgcgtcgttggaaaaacatgaccgctcccaaattacaaggcatgcaggaaaccaagtcatcatacaaaaagtaattagctaccacagctgtaccagcaaaaatactgaaacagctcactgcagttactgagctgacgtaagatcctaaaaatgctaccgaagtcgtcaatgctgtaacaaacatcgacataaatgcatgatgaaatgtgtcagtcatgatttttaataaggaacatcccgggtcctgcttctgaatttgccagatcttacaaaaaataaatgcatcgtcagaaccaatacctattgctacaactgtagccagcaaattcatgaaaggaaaaaatttgatctcgaacacaagtatatacataaaataagatatagccaaagaaaatataatcacaattattgtcattattgtgaggaacagcgaatttgtgtaaagatagatacacataaatacaaatagagctcctgcccccataaggtaagtatctcgtactagacattcatcaaataatgcactctttattccaaaatccattgccaccacctttattccgtcatattctaaagtgagcttctctaattcatgataatatggtaaaatggctgtactgctggcaagcggcaaaaatatcatcacttctttcaattctgatgactcttctgtattattctctggaaggaaggaagtgctcgtcaaaaaattcaaaatattgaaaactgcatcatgtcgcagacactctattggagcttcacaataacgtgtttttgtcaaacattctgaattgagttccagagcatgaaagtattgagcacatttcactaaaatttgtttgttctggttacatcttcttccgttatagcgagacatgaaagttctacttattgaaaagagcaatatagtttggaagggtacctaggggtttgcaacacctccgtcttggactttg

SEQ ID NO: 316 - DNA, 664 bp, Leptinotarsa decemlineata
  Annotation=Mitochondrial import inner membrane translocase subunit Tim10, putative; Tribolium gene name from OrthoDB database=TC003366; Blast E-value Tribolium Gene vs. Leptinotarsa Unigene=1E-49
tttcaaaactgaacatggtttaatgaggttctattaacaaaactactaaaaacgactagttcatggttataaactactttttcaataatgcttcgtcttgcatggacagctgacccaactttttgccaattctttcgtgaatatcgaggaatttggcgacacacctatcgatgcagactgcttcaccttttgcaatttcagagtcaccgtaaacaggaggaatgcattttttatggcacgctgacgttagacgattgtacatgtcagccatcatttcaatttctaactcttgaatgagctgcatgttttgtgcttctttctgagccatgctgagatatttgaactatttgaagatatatactaagatgaggtagagaattttcggtaactacgctcgtactctccactgtttgattgtctaatgtgctctcttattttcatattatcatatcgccttttatctacgctagttttggccagataaaacgaaaatattccacaaacggtaacaacagcccagccaattccaatttttgcgtaattagccaatggcattatttactcatcggttcattgaatgtaaaaatttgatgtttcattaatcatccaaaagtgtgacaaaaagcaatgtccaagtgtagggatgaaaagcaggttaaattcc

SEQ ID NO: 317 - DNA, 1414 bp, Leptinotarsa decemlineata
  Annotation=DNApol-iota, isoform A; Tribolium gene name from OrthoDB database=TC008961; Blast E-value Tribolium Gene vs. Leptinotarsa Unigene=0
tcggtctcacttatgcattttatgtttgttactgactgcacttcaatatctttgactaggaaatttgttaaagcattttttccaatggaacgctgatgaaatttagtgaatgacaaaccaagtaacgttaagtggtagggtttagtactgtccactagtttactgaacaaacgcatgataataaccatgaccttattcagagcattttcacccaatttggtaacatcaccgcaggtgaataatgatgaattgatgttgcactgttttgtttcccgaacacctaatttgctgcttttatcaaacttgcggactgttaatttgatagttctcggaatacggccgtcttcagcaactagtactaagagcctatttaaaagctgaacaagtttctctttcacttctgtttccgctgaaattgacttgcagctgtcttcaatgccaatgctttggggtttaccagatgactttacaagtattcggtctattccaaaactcaaatcgtaaacttgttttgctttttctggccctaaaagtccactcaacttcgatatattagtactttggaggtcttgaactgtcttaataccgatactgttgagttgttcggaaaggaccacgccaatactgggaattcttgaaactccatctaaagtcaacatcaactccacagcactgtttgggaaaacaactgtctgctgatttggcttatgcctgcttccggcaattttggataaaagtttgttgtgtccaatgcctgcacaagatgtcaaaccaagttgaactttgatatcttcacggatattttgagcaataatggaacctattcctagtctctcactacatccacaatcgcacatatcactcgtgtctccaaaaatattaccaactgcgtcacagtttgctccagtttccaatcgttcactaacaatcctcgacacatctataaaattctcatcgagtcccaaacgttctactaggttcgaatacttttgtaagagtgctgttactttgtacgacgtttgcctgtaatcgtgcaaatcttcgcctttaaccaataccaagtttggacaaagtttaaaagcatcttctatcaacatgcactttttaattccgtactcccgagcaatgtaattgctggttactaggatgttcttttgttggatacccaaaggaacgtctctcagtttgggatttttattcatttcaacttgagcataaaaacagtcaagatctacatgaataattgttcgcgagtgatcgtccaaggccgtatctgactccattttttgtgaagatgtttcctggatttaaacattcaaaacttgaatagtaataatagtaacctaaaaatttatatttcttatacaaacacaaaacacaatcacttcaatttctgattatatgttctctccct

SEQ ID NO: 318 - DNA, 790 bp, Leptinotarsa decemlineata
  Annotation=Mitochondrial ribosomal protein L11; Tribolium gene name from OrthoDB database=TC009555; Blast E-value Tribolium Gene vs. Leptinotarsa Unigene=2E-9; Blast E-value Tribolium Gene vs. Leptinotarsa Unigene=0
ctctatttattcttgaagaacccaatatggacactacagagaataaaaactatatacacagaattatgttgattggttaatccatgattcatcatgtagttcaacaaaacagttcaagtgaaagtagtccaataaattgactgacttgaacattaccctgttctcaacatttttgcttccttcttttcctgcaattcttttttctgattttcttctaccactttcctttctgccaaaaattctccatactctgtaggatcctgtttttcaacaatttcaattccacatgatctagcaactccaataatcattttacatacttcttccaatgttttcacttctagtgtagggtcttcctgcttgattttggcaatttcgtaaacatgttttaatgttatctttccagatatttctctgcctggttccatagcagctcgttgaatgcctgcagcttgctttagaaagtaaacgacagggggcttatgaatgaccatctcataactccgatcaggatttacagtaactctagttggtaagggaattccttctttaatgtcttttgttctctcattgaaatctttacaaaacgctgctatatttactcccctttgacccagcattggacccagcggagggcccgcagcagccattccagcaggaatatttgtccttaatttaccatgttgtaccttctcaactactttttttgctgttttcagtctggcacttacttttgacatgatttattaaaaaaattataacttcagtgaaaatatatcctctaacctcc

SEQ ID NO: 319 - DNA, 2359 bp, Leptinotarsa decemlineata
  Annotation=Nucleolus protein required for cell viability; Tribolium gene name from OrthoDB database=TC008696; Blast E- value Tribolium Gene vs. Leptinotarsa Unigene=0
aaaacatttttaataaaatctatttacaagaaaatatacatttcattccgaacctgtcaccatcatatgaacttttctgtcactctgtatcattttggcggctttttctgtcccaacacaggcagacagttgatacacatcatatttcgaatagatcacagtaacagtcatattcgaggagctaccgattttcttgttgaggtaggcttcttgcatcagattgcatatttcatagtagaagtgcggaaaaacaggcagctgatagaatagaaggtgacgaatgccctttatcctctttctgttgaaaaagtggtatctttctgtgtacaacagaaaatgagcgtctccatggaaaaacatgtccctggcacgtgcaattttcgcttcctttgaatactcgcaaatctgcacaaacccgatatcctcctttctgaagtaatttctcagtcgaacataatcgaaataacttggcacaaaaatcattgtttgtttcatcaaagcctccctttgctgcggtaatattttatcgacaaaaaactggaatctagcatctacagcttcagcagcgctcttacattcaaatcggtggaagacgtgaggaacttgaacaaccacctgactgatagtgccgaagtcaatggggttaatgactttcactttaccagcatagttatggcactttttgttgaagatggcgttgatttctgctgaatttattgaagagaatatcatggtgtggcggtagtattttgcccaaccgttcaaactccaagttctcactctggcgaaatctgttccatgggagtccttaggctgtaaatgcaagtgattgacaatatgaataacgtgatcccaattttgcatcaaaaatatttcagtctggtcaaaaatgagaacttctatagaagctaagaaatcataatctcgttcaggttctccttcagccccaataattgttcttagtcccaaaggtgaagcgataatgatatccgaagaataaaaatctgcataaagctttatactcttttttgttatagttaaacctattttgaaatcatcactagtattgccctgaaaaatcagttcgtagtcttctggttttggatttttaggtaaaataagttcatttcctgtatagtcctcttcaaatctatttttattcataacatttcctttatcttcttgtaaaattaaatcaattatcattctgacagttttgtaggctgcatccttgaacggaacaactatgagaaccttaggcctgactaaaccttggtctctaaattcctctggaacatcatccttctttgagagtttcgagttatgatgtataactttagttctagttttcaatacatgattcacagcatgcagacagtaaacatatcgtatttcttccgaatttgaaaatgttctgccaggaaaataaaaatcttgataattattgattacggaaaatatttcagcttgtaatgggctgaatgtttcatcactacaatgtttcaaattaactttaggtaggttacctataatttgagatttgatgaataaatctgaaggttttgccgttctttgaattctttctggcacagaacctggaggggcatatatttttttctcagcaatactgaattcactaggttcttgattcacaatgtcattgcattttgggatttgtatagataattgtccaagtacaggccaagtttcacaggaagaaatgacagatgcattttgtagtgattctaacatgttgtcatgcaaatcatgaaaaatatgtttggcgaaaggatcctcagtgttatcaataccttcccatttttcactatctggttctacgtgaatttcctcagtgtggggatcaacttcttcagaatttgacattttatcttcatcaacattcttttcactttctacatgcgaatcatctccactggaggtactatcatgatcacttttctcttcagcaggttttatttcttccaaaactgtctgttcctcagtttcgctctcactttcactctcactactactttcgattgccaccgactttttattttttcctgatccagtaaatgtacttagtaagtgatccagatctccaatttcctcttcagaagaaatgtgttcttcttcgggttccatttcctccagcttctgccttttaggattcactctttcatgtggtttatcgttattaaactttcttttaggtcttttattctcctcatctttcttaaataaactgtacgttttcctcggtcgaattttttttgggcctttcttggattgaagatgaggtttcttaacaacatccttatattttacttttccacgtcgagccatatctgtttaattt

SEQ ID NO: 320 - DNA, 1349 bp, Leptinotarsa decemlineata
  Annotation=Zinc finger protein 330-like protein; Tribolium gene name from OrthoDB database=TC007558; Blast E-value Tribolium Gene vs. Leptinotarsa Unigene=3E-175
gttatatgtagtgttttttcagtagctcactgctatattagattttgagtatatttaactttaatttcatatattattaacgtgtatttaaattttgatcaaatccaatttcccgtacttctcagcacaaagatatttaaaatattgagctgtaattgacatcgtataaattaaattttttcaagtaaatgtattgaagaaataaaatttgacctgccaacgttgctttgattaccatctacccaaaagcaacacccaactcgtttccgcgtcctccgtcacttttcttttgcatatcttaacataacccgcatgtgataggtttatagtttgtagattttcatcagcatttgacatatttttggtcgtttaggaaaaattaataatgcctaagaaaaaaactggtcaaaggaagaaggcggagaagcagaaactacgtcaaaaagaaataagggcagctaaagaaaatattgatttagctgaacatccctgcaatatttcaatggaatgtgaaaaatgccatcgtaaacagaggagtagggctttttgttatttctgtcaaagtatacaaagactgccagtttgtgctcagtgtggaaagatgaagtgtatgttgaaaacgggagattgcgtgataagacacgccggagtttatacaactggaatgggcatggtcggtgccatttgcgatttctgcgaggcttgggtatgccatggaagaaaatgcctccagtctcacgcttgcacttgtcctttacaagatgcagtttgcatagaatgtgaacgaggagtatgggatcacggtggaaggcttttcaagtgttcgttttgcacaaattttctgtgcgaagacgatcagtttgaacatcaagcatcttgtcaagtactggaggctgagagttacaaatgtcagtcgtgtaataaactaggacaatattcatgcttgagatgcaaaacttgctactgtgaggatcacgttcgcaggaaagggttcaagtatgagaaaaataaacctattccatgtcctaaatgtagctttgaaacatcacaaactaaggatcttagcatgtcaactcgtagtcacaagtttggaagacaaggattgaattatgaagatgaggatgatgatgggaatgaggcggcaggtggatacagttatggagacagtggatacagttatggtggtggtgattatgatgaagaggatgaagattatgatgaagatgatgatgaagatgaagaagatagtagtgatgagagttcagatgaaaatatcaatgataataaaaataaaagtgggatattttgtttattacactcacattcaaatgtaataaggtgcctaatac

SEQ ID NO: 321 - DNA, 1269 bp, Leptinotarsa decemlineata
  Annotation=Developmentally-regulated GTP-binding protein, putative; Tribolium gene name from OrthoDB database=TC005461; Blast E-value Tribolium Gene vs. Leptinotarsa Unigene=0
tagattggttaaattttttgctattctgtggtctgcactttaggattaatgtgttaaatgttttgatattttgtttttattttacctgaaacatcttcaaggtctaaaaccatgggtattttggaaaaaatttccgaaattgagagggagatctctagaacccagaaaaataaagctaccgaatatcatttgggactcttgaaggctaaattagctaaatacaggtctcagttactggaaccatcaaaaaaatcagaaaagggggaaggatttgatgttcttaagagtggtgatgcaagggttgccctaattggatttccttctgttggaaaatctacgttactgtctactcttacaaaaactgaaagtgaagccgcttcatatgaatttacaactctaacatgcataccaggggttatagaatataatggagccaatatccaattattagatttaccgggtatcattgaaggtgctgcacaaggaaaaggaagaggtagacaagtcattgccgtagctagaactgcggacctggtgttgatgatgttagatgcaacaaaaaaagatgttcatagagatttattagagagagaattagaaagtgtggggataaggctgaacaagaagaagcctaacatttatttcaaaattaaaaaaggcggtggcttatcattcaattcaacttgtcctttaacgaaaatagatgaaaaattagttcaactcatattacacgaatataaaatatttaatgcagaggtattattcagagaggattgtactgccgatgaattgattgatgtcatttgtgcaaacagagtttatttgccttgtctctatgtttacaataaaattgatcaaatatctattgaggaagtcgatagaattgctaggcaacctaatagtgtagttgtaagttgcaacatgaagctgaacctagattatctactaacaactctttgggaatatttgagtctaattagagtttatacgaaaaaacctggtcaaccaccagacttttctgacggtctcatcctaaggaaaggtgttacggtggaacacgtctgccatgcgatccatagaactttggcagctcaattcaaatatgctctagtttggggtactagtacgaaatattctcctcagcgtgttggagtcagccacacgatgcaagatgaagatgttattcaagttattaaaaaataagatactcgttttgtattgctcagttatgattaaaacttttacaaggtaaaaaaaaaaaaaaaaaaa

SEQ ID NO: 322 - DNA, 1347 bp, Leptinotarsa decemlineata
  Annotation=Acyl-CoA-binding domain-containing protein 5; Tribolium gene name from OrthoDB database=TC009203; Blast E- value Tribolium Gene vs. Leptinotarsa Unigene=2E-91
gtggttgtacagtggaatgagtgatgagtgattcgtgcattttctgatgtgattgaatattaatgaatattgtgaagagttggaaagggaaaaacaacatttttaaaaaacgttcatgtgatgtatttttatttttttttatcgtcgatagtgaataagtgtaaaaatttctttttctaatcatgacaaccgagcaaaaatttaacgcagctgtgaatgtaataagaagtttaccaaaaaatggatcctatcagcccagcaatgagttgatgttgaggttttatgcctacttcaagcaaggtactcttggggattgtcaaggttctcgaccagcattttgggatgttgttggaagagccaagtatgatgcatggaaggcccttcaaggaatgtctaaagaagagtctatggccaaatatgttgacgaacttcattcgattgttgaaacaatgagctactcagacaaggtagcaaatttcttggaagcccccacagacgaattagattcaatcaatatagatgatttgcagttagtggctggagatgtgatagaaagagttaggtcactccctaattcacctttggcttcaagagaagcgtctcctatcagatttggatctataaatgattctagtttaggatctagcccatctgtatctccagagaatccagttgatgactctgatagaagtgatgatgagtatatagatacaattgagaatcctgagcctcgcaaacctgttacaagttacatatcaagtgaagttattcctaatggatacattcaaggtgctcaaagtcatcatgtatcaagagcaagaactaggtcattttccaatgtagatatatcacaagaaatttccagggcagtgcagagtttgaaaaacgacattgagaggttgacaaataaggtcacctcacttgaaaatgacaataggaacatggcggctttgaggaggaaaggaaattttcaaggcatgtcgacccagctcatcatatttattataacctggccatttgttgcacactacataatgagcaagtttctgagtaggcgaaattaattaaaacttgggtagattatgttttattacagttgattaccttaagtgaaaaatatgggatgattgttgtaatttttaacttgatcttggtgatttttttatttttaaggtgatgtgtaggtgtgtgtgtgtatagttgtcgaaatggtctgaaatgtttttgttatgtatatataaagttttatatcttatggtttggaataattacatagtagaaaaattaactttgtttatttaaatattccgaatcctatattattttcctaaatatatgttgtacaat

SEQ ID NO: 323 - DNA, 397 bp, Leptinotarsa decemlineata
  Annotation=Putative uncharacterized protein; Tribolium gene name from OrthoDB database=TC012057; Blast E-value Tribolium Gene vs. Leptinotarsa Unigene=6E-26
ggactgacaccgagtactagtaatattctgttacactgacctatttttagggagttgtaaagtaaatggtatatttctaaaatgtacagtcttagatttatatacagaataaaaaatatgaaaaccaccgttaatcagaatatgataagaaataaaacaactactaaacgtggaactatactgcaagagccccatcgaacatcctttggaatcttaaaattgattttaactgtggttcctgggttactcattggagcgacaataagtaaaaatattgccaatttcttggaggaaaacgacttgtttgtaccttcagatgatgatgacgatgatgactaaaataaaaatatctaagtgaaagaatgtgatcttcctaaattattttgtgctttatatg

SEQ ID NO: 324 - DNA, 726 bp, Leptinotarsa decemlineata
  Annotation=PREDICTED: similar to AGAP007709-PA; Tribolium gene name from OrthoDB database=TC015503; Blast E-value Tribolium Gene vs. Leptinotarsa Unigene=1E-43
caagtctaattcatctagcgattctaattttgcgattggagctattttttcttctttgcattccttttcctttgctattagacactccgcccaagatggttcttgacttttgtcaaaatcaaaagctttattaaacgatgcaaacctatgaagaacttgggaatgatgattttttgatattggttttggctcactaactgatctctgaaatgtatatctacttctacttgggtctatggctacattttcatattcaggcatctcttgtttaatggtagaaatctcgctgccagacggttgttgtgcttgtaacagcgctagaatcattttaacgtctgtagtgagtgtcgtctctaaagattgaacccttttcgagagttgatccagcttggagttgatatgatcgagatgactcctacttattactaaattttccgaatgtgaatctagagtggaatgttgcaagtgtacatggttcgttgtggcctccagtggcaccagtatctcctcggcatgatttcctgtatcagtaccgtgtggtggactagggctattagtataatagctggtactgctggaaaggggcactgtactgtgctgaggttgatgagaaacagagtgatggtgtgcctgcgttgctgcaacggcggtctgttcttggtgataggcgccagttgaagactgtcgtcgaatggtgcgtgttcggtgactggagggaggtgtcga

SEQ ID NO: 325 - DNA, 781 bp, Leptinotarsa decemlineata
  Annotation=Elongin b; Tribolium gene name from OrthoDB database= TC004834; Blast E-value Tribolium Gene vs. Leptinotarsa Unigene= 7E-4; Blast E-value Tribolium Gene vs. Leptinotarsa Unigene=0
gagaaaagagaaatcatcattttgtatatatatatttgcacttgtacgctgttgacttataaagtgttgctgaattattataattaatgtttgtattatacaaaatccattttctaaacatataaattcagaaaagaaaccatcactatggacgtgtttttgatgattcgaagaaaaaaattgacaatatttaccgatgcaaaagacaccactaccgtctctgaactcaaaaaaattattgaaggtatactcaagattccaccacagaatcaacaactcttcaacaaagacaacacggttatggaagattcctacatgcttcaggattatggactgacagcaaccacagcaaaagcccaaagtcctgccactgtcggcttggcaatcagagatgacagcggaatatttgagcaactggatctagttccttatctgctcctccagatttaccagatgtaatgaaatcccaggagagcaacagtcaagagcaatcatcttgagcttgtgcatactagctgtaatgtttatttctcagtataacatcgaaagacttttgttttgagatgattggattaataatttcattctaggttcttatttttttttaaaacaaattttaattgtgttccctatgaagatctgcgtctaagtaacagtaatgggtacactctgatggatgttgcatgcttaggaatgtattttaaggattgaatagaagatacctaaaaataaactcgttttattatgtgttctgttaacttgcaactttaccatgtatact

SEQ ID NO: 326 - DNA, 1517 bp, Leptinotarsa decemlineata
  Annotation=Glutathione synthetase; Tribolium gene name from OrthoDB database=TC006049; Blast E-value Tribolium Gene vs. Leptinotarsa Unigene=6E-152
gactagaacagtatttatagattcaaaaaatagtgatggcaaagtagtacaaatgaagtagttgaaatgaaaagcaaatgaaaatttgatatctctgctttccatcaattgatggacacatggataacagttttatacatctgtttattcaactgaaatttttatttgtattatttgaaagtagggtttttccactctttgaaattaaccgagttcagaagatcaaaaaagtatatacaaaaaaaaccgatttccaatcttcaactttcaattatatacaacaaaaaattagttcaccaccttcttccataatatctgaataaaaataacaaagacaacagttttgtaactggatcttcagactactctcagtgtacaaatctatcaatataatgcactatctcgaagaacacttccaccataatgagaactattatcatccattccaatctaacatgatgcttgtcactcaaatgggaagataacagttctatcagctctacacagtgattgatcttctcattcatcacctttgttcttttgtttatacaaaaatatgagcagacttgattgtaaaggttctccaaatcttcgttgtcccaatagaagtcaggtgtgtccagcacgtcagaactgagattcatgtaatgcctgagagcgaagagttctccgtgcttcctcagtaccgcctctctagacatccgaatcttcttgccccttttcaaatcctctgtcacgaattcgatctcatcaatgtacttttccaatgaggcctcccagacacccagtttcacattgagcataatagcatttgaaaaagtgaatttctctaatgttttgtcctgcccgggagatagtaaaaaatctccttctttactgatacagctgcttgttttgtctgcggattgatatttgtagttcatgatttcgctctcggattgaacaagtctttctgaatagctgtcttcctcatattctctcagaaaattcaaaatgttgccactttcaaggtctgtaatgttccataaaattacactaccttccctgaaaaaaaatatttctctaggttcctcgttcaccctatatttcgccacagcatgtacaacgtcagtattattttttatttctttgggttcgtagagattctgttcttttaaacccttaacaagtttttctagatcgtattcctctgcagtggcgaaagctactacattgaagattccaggtttctcctcctcctccaaaattttcttttttcttgtcactcgtttcttaacttgaattgaagaaattgtatcgtgtatactggaggatttcacagtagatagttccttatgcaaaattgtgcaagtatttttgagaggcaattttttgaggttcgaaatcaaattgaaagtggttggcggaaaacgtatgtttgcaaaactacggcatatttgcacaatttgaatgttattttttaacaacattcaatagtaaacaattaactctactaaaagccatgattacaataaaag

SEQ ID NO: 327 - DNA, 1370 bp, Leptinotarsa decemlineata
  Annotation=Diphthine synthase; Tribolium gene name from OrthoDB database=TC014546; Blast E-value Tribolium Gene vs. Leptinotarsa Unigene=8E-123
agatttttcagttgaaagtttataaaaccgctttaccatagcatcttggggtgtcacagctgccctctattctgttctcatgatgttaatcagaactcaatgagtaataaaaaaaatcgatttattgtttaaaaaatgagctggtactgaccactaatgaaagttccgcgaagttcttagtttcaaaaatattagagaaataaactaccgtacgagttgaagagtttgatttcaccttgaattacagttttcaagaattctttcattcggaaaagagttcttggagaataaatatatcataattctcagattgtcagaggattcctttgcagttcttgtgtttcactctcgaatttcaataaaaaactctccattcctatagaaaaattgaatggaagcaaatttggataaaatatattttatttagaaacgttatcacaatcgatattgttctaagaattcttgctcaagaggatgtatttctggacctactataatgagagaatgtaaaggtccacccaagtcaaatttcgacatttcacgtaaactacaggcaacaattttttgtgtatctgagcctactcttgcaagtcctacacataaagtttcatctgttattactacattctcagcagttttcttaaccttatgtactatttcaagaagttggtcagaggcttcacttacagacataaatctaggaggcatatattctcttttctttctggtcaaactttccactgtaggttctttaactttaatgtccaataaacataaggtgtgtaacttgttttgatagtttttagttattttttcaaaaaaactgtctggtttccagttctcagtccaataaggaattgaaatggtttctccaaagctgtataactgtagaccgcagcaacctacagcatttaaaattgatgcattatgaactacttgaaaggaaaggcccctatctcgtgctctcaaaatgagatctgtatgtgttgttgctccaaaagggtctcccacaacaagtaatgcaatatcttgttcttcagatccactcaatatatcatctgcaccttgttctactaaatctctatcagctatcaatattttccgtccataaaacttctcgagaacttctacaccacatgttaaaattgaagtataggcttctaaatagactctatcacatttcctgacaatttccagacctttcactgtgatatctttgcagtctcccagtcccaaaccaataatataaaacatttctatttattgttgtagaaaaaggcccttatttgcattaaaataattatgaggttgccaaaaattttatataaactgtgaataaagcgttttcaaaacttcccaacttttcctgc

SEQ ID NO: 328 - DNA, 461 bp, Leptinotarsa decemlineata
  Annotation=Mitochondrial NADH-ubiquinone oxidoreductase 9 kDa subunit-like protein; Tribolium gene name from OrthoDB database= TC007332; Blast E-value Tribolium Gene vs. Leptinotarsa Unigene= 9E-34
gaagaaggctacgggcatctgtatttcaacatttctatttccgcttcaaaataactggtcttgtcataactgaaatattcaggatttttgtatccagaattcttcgcagctccagggcctactggacctgcgggaactttgaggcaggcttcagaaaggcctggtacgtttggtaatgcaggcgtttctttagagatactctttggagtatatataatttttcccagagtaaaattacgtttcaaagaagaaaaatgtctgatcctcttcaaattactcaatataatttttcctgttgccattgttgacgttaggttaatagcgaaattgagtctctttgttactagactgaaatgctgaaacgactgaaagtgacgatttgaagacaacagattttttaaattatgtaatgatatatttcagattgattcaggatgaatatgaatgcttcctcgagttat

SEQ ID NO: 329 - DNA, 681 bp, Leptinotarsa decemlineata
  Annotation=Coiled-coil domain-containing protein 43; Tribolium gene name from OrthoDB database=TC013921; Blast E-value Tribolium Gene vs. Leptinotarsa Unigene=2E-6; Blast E-value Tribolium Gene vs. Leptinotarsa Unigene=0
ggttgaaggaaaaattaaaacaacttcagacagatgaaactgtgttcggctcttacattcaaggaatacttgaaggtgatgacactcaggaagaaaaaaacgaagctctcgaagggctacttgcggagatagtagaaaacgaaaacgaaattacaaaaaattgcaatgaaatacttgaacagtggcagttacataaaccgaaaatcactgaaactcaaatgtctagtgaagatgttaacaccaaacttgctaagttattggaatctcaatcatttactactaccaaacagaaggagtatactcaggaagagagggaacttcgaaatgctattctctcccaatatagtgcaatgactgatgatgagggtgaaggtgatgaaggaaatagtagcagtgatgaaaatgggttggaaagaaacattaatgctcaaactattgcccaagccgaaaagctcaagagagaacaagctcgaattgatagtcagaaaaaaaggaaaaagatagagaagacagagagaaacagaagcaactcaaagaagaaaaaaggaaaagcgcaagactgttaaaggtgaacgtaagaggtagcatatctgagacaacgaattagcaattatgtggtctaaacaatacatgtttttttaatgtgttgatgatgtgatttaattttatttggcctgtaaa

SEQ ID NO: 330 - DNA, 497 bp, Leptinotarsa decemlineata
  Annotation=Coiled-coil domain-containing protein 95; Tribolium gene name from OrthoDB database=TC009249; Blast E-value Tribolium Gene vs. Leptinotarsa Unigene=5E-28
catggaattcgtccccgagagagcaccaccaacggttccaacagaaatgttcagcaacgaaccatctttagacagtgaatcaaatgacattggagagctagaaacgtcacctagcaatatgggcgaagaacttagtattgacatgataccagaataaataatatactcaaatagcaaattatttctcctggaagttttacagtgtttaaaaacgaacctagggaacagacggattttttgtttgtgttaaagatgatttttataaaataatttatatctaggacatattttagatgaatgagaaaaaatgtatctgttaaggtgagctagaggggcatgttctgttcttttgaatagaaaacacaaatgtgtggatatagtatctattagtatatgtttatgacgttaatattgatttgctgaaatcctcttgtaaatattacagctcaaaaatatcttcctttatgaaaaaaacataattataataataataataa

SEQ ID NO: 331 - DNA, 551 bp, Leptinotarsa decemlineata
  Annotation=CG2906; Tribolium gene name from OrthoDB database= TC004755; Blast E-value Tribolium Gene vs. Leptinotarsa Unigene= 4E-2; Blast E-value Tribolium Gene vs. Leptinotarsa Unigene=0
gcttcaaacgtacacactttgaggccataaccaaaggccatcattcgactcagatgccccaaacctgatccaacatctactatgtgaaaacagttggtctttttggcagattcgtaacatttttgagctaatctggttatctcgtgccttttttttcagtttcacgtttttccaaaagaagttcatgaagtcatcatcggttttgaatgcaaagagaggggccaacttcatttcacttcttggtatactgttacgaatcactaattcacgtaaacacagtaatgccaaaggatatattttatcttctagagatctagtaggtatagaaaaattcaggaattggcttagaggtttcatttcgatatccgaaaagtggttttgccatgattttggtaatttttcccaatggttctccagatagtagtcagacacataagagttcaaaatgtcctcgaattctttgtaaattttgtaatttacttgtaggttcctctgaatattcattacttatctatattttacttcagctgatacaaaaatttctcattttc

SEQ ID NO: 332 - DNA, 1024 bp, Leptinotarsa decemlineata
  Annotation=Ubiquitin-conjugating enzyme E2 S; Tribolium gene name from OrthoDB database=TC011975; Blast E-value Tribolium Gene vs. Leptinotarsa Unigene=2E-122
aaatgaagttttattctatagatttggtgataaattccaaaaactaaactcttttaataacaatacattgaaaattttaatggggtttaattatacaacaaattattggcaaaagttaggagtactatgaaatgtttgtcgctaaataaaaaaaaaattctcaacaaaatgcacagtagatttcaattcttgaactaaaaacatataaataaaaatttattggtaatatttcatataaagtaaaaagtccataaagtctcataaacgtttcaatgtcctctttttctctttcataatctttttcctttccgccgtcattttcttatccccagcatgttttttggccataggaccttctcctggcaggcctttacatttatgttgttgagcatgtatttctgtcatcattttggctctttgtgaataatcatcgtaatgttctaaaagtaacttgccggcttcttcgttaagagcagactcagcatttggaactattagaagacactttatggttaatagtatatgtttgattccgagatcagatttccaatcttttttaagagtattgacacaaatttccccatttgatgctacattggggtgaaaaatttttgtaatgaagtatgcctttggtggctccattggaaacccctttccgagagcaagtttgactttgaacaagcctcccatgtaaggtgtacctgctggtccatcaatgaaagcttgtatatcagtaacgtcctcttcgtttatttgaactttgattccctcgggtgggttattgactagatcttgcatttctttcacaacccctctgattatttgtggagatagattctctacattgtttgacattgttccaccggaagccataataaaaaatatcactatacctcaaccaaaattaccaaaactcaaaaacacattaaagtatcgtcataacaacgttaacttagagctcttcaaaagtcagacatattttgaattttcaaaccaatcaaatcgctttcttgatttcttcttt

SEQ ID NO: 333 - DNA, 1207 bp, Leptinotarsa decemlineata
  Annotation=Cyclin-C; Tribolium gene name from OrthoDB database= TC002120; Blast E-value Tribolium Gene vs. Leptinotarsa Unigene= 0
ttgattgataatgaaatttcacaatttaattttcaaagaaaataagaaatacatttatttcatttttctaggtaaaaagtgagtgcatgttaatccaatggatttgaatgtattgtatgaatgagaactttctatcaaaaattctttttaactactcagtacagttggagaagaaaagtaattatgattattgctgaaagttcatcagttcatatatttttaaaaacattaagcgtatatttgtaatacttgtttaatcatccatcacactatctttgaggagcaggtttgggtttgggcattttgctcagtaacccttgtatttccttcttctcatcatatgttttccacaattcgaacaaatttataatataccttgctatttcctgaatcttttctatatctacgttaagttccgcaaaccaagctttgtggtccttttgaagaataacacaggctatttgcagacaacctattgctatttgatatggaggatatagcaaagaaacatcagttcttaacgaatcattaacaattctccatgccaaagtaaggagttgttcctcatgaccaatatcttgaaccagctgtaaaagaggtctataaggttgatacacaatgagacaacagtctaaattttctaaaaggtagaactcgcactccaaaatgtggttggtccgataaggaaattcttgtgtatatgcatacccaaatttatttttgatgactgtttgacatgttgtgacaagtctattatttgatatgactccaaattcttcaacctttgatgatagaaaaatacaagttggtgccaataataaaggatcaatacatttcaacgagttccttgcataaaacctcttaaaatatacagtggcagtggctatgacttgttgtctgagtttcaattgctctcccaatgtttgtattacactagaaaaaaatataaaaattttctgatattcttcttcttgtaggatagacagatcgtgttgcctttctcttatcaagtcttgcttatctaaaagccactgttgatgatgagaactttgccaaaaattaccagacatttcgaaatcgtcttagattagacagatgagcaccaaatattttttattacaacactacaataacttaaaagcaataactttaaaaccggccgccgagagaaacaaacagctgatttttgacatagaggctttgtatc

SEQ ID NO: 334 - DNA, 656 bp, Leptinotarsa decemlineata
  Annotation=Insulin-degrading enzyme; Tribolium gene name from OrthoDB database=TC001879; Blast E-value Tribolium Gene vs. Leptinotarsa Unigene=3E-54
cgtgcgtctggtttcaagagttgctcatttgaatttgtgctaagagacacgggtgtcgtcagcaatttctggaaccctgggtttcttcttttgtttgttgctgttccgttgctgctttctccttcaataaagccaatttctcctgcaattctagacatttttgttggtgtttttggtattctgttctatgttgtcgtttcatagtcttggtcatgttttgttcattagccaaccctaacgctgcttcagccatgtttgcatgcagttgaatttggatttccaaatctgttatcattttgtctttattgtttgcatttttaacgagtttctcaggcaactggtatgatgtacctatccgccttctaatcaggggcggcgtctctcctggttccaggggcatctctggcggtgtgatgcccgtcaactctgcttcctgtatgcataattgcctcagttcttgatttctctttgctaaaatatcctcaatttgcttcttcctctcctgtaaagcagttattctggcaatattcaaatttctagtagcacccatgctggctgaattaggttcttctgtgtttacaccatcctcttaaaacataaataatacaatcagtgtggtttgtggagctatctatagtgttatcaatcaatgagtc

SEQ ID NO: 335 - DNA, 1241 bp, Leptinotarsa decemlineata
  Annotation=Putative uncharacterized protein; Tribolium gene name from OrthoDB database=TC001879; Blast E-value Tribolium Gene vs. Leptinotarsa Unigene=6E-48
gcacagtgtacccagtcctaatgaacctgttgtggatcccaggttctcccaagatgtgtcaagacatccttacaggtactccgaaattcctcacgtcggacttcaacctattaaaccagatgatcccttgaattccggattttatcggctaagtctgaatggatatagcgaatatatggaaagacgtgagaacataaacaatgtctactcgtcttccagctataatccccactcagcaagtatgtaccacctgtatggctctcaaatacaacctcatcaacaacatgccctccattaccagcaacatagtccacacatgtcacaacatagtccacacatgtctcaacatagtccacatttatcgcaacatagtccgcatttatctcagcatagtcctcataggtcccagcaaagccccgtcttgccccaacatagccctcatttatcccaacatagcccacattatagtcatttatcccaaacaagttcgcagtcgtctctgcatagtcaccacagtattccccatcatagtccacgcaaagtacaacatagtccacaacctccccagctgtcgcatcagcgtatatcccagtacccacaatattcacctgattttcctgacatgggtctaaccagtcacaggcagcctagtcctactgcgtccctttctcctaaaactcagtattatccttcccatgcagtgctcagcaggtcgacatatagaaattcacaccagatacagcctcatcaacaatatgaacaaatgaatgtggtgaattcaggattaggcggatgctggaaaaaaactgggaatggagagttggtatggtacacttcaaatacaattgatgctagttggcagcgggacaaaaggtttggtagtttggatagaaggaaaacgaaaaaagctagtaggatctcacccaacttagaaaacaaatctgcaactatctccacagtacccaattatcacggccaaggaagaagttctgtaaaaacgtcgaagataataaatcgcaggtctcaagataatggacagttagttcgtacccaatctctagggagtgttggagcgatcactcttgatagtgtgtaccctacggatgacagttcctcttatggaagtgataacagagtgcctgacggaaatgtgacactaaagaacctaaggaaaggagtggtggaaacttctactagatggaccggcatttccgctcaacctactctttcctcgtctcagc

SEQ ID NO: 336 - DNA, 1171 bp, Leptinotarsa decemlineata
  Annotation=Protein C10; Tribolium gene name from OrthoDB database=TC005394; Blast E-value Tribolium Gene vs. Leptinotarsa Unigene=2E-53
agttcacacgctgagagtgttatttccacaaaccagagagtaagtagtttgtggttatttcggactatatcatagcataggtaacattgttacttatgctgtgactatacaaagaaagaaccaaaacaaattatttttcaattgaaatcttcaaattgtatttaatttttcctatactgttttgtttatttataattaagcaaaacaaaaaaatgtcaagatcagatgtaattcccacgttgacccttgatttagcaaagcaaatattaactaaaaccttagaagaattacaaaaaccagataatgtacaaaaattggaagaagcaagagacaatgttggaaatgagatgttgaaaatgatgcaatacctttttccaatcgttatgcaagtacaaatggaagttcttaaagaatttggataccccgagggacgagatggtattataaaattttctcaaatgctgagaaattttgaaagagatgataacgaaattgcgaggatacacggcctgataaaagcattatatttaccaccagtatctgtccatacaacaaatgaatcacccagtgacgaaaagtcaagtagttgattttatagttgtttttgactgcatataaaaactcatctatactggtgtaatcccaatatatttatgaaaattcattttgaatttcttgtaagtgctatacctacactttgaactcctgattaaattcggtacttcataaaggcagttacagaggacacacctgttcttagtaatgataatttttcaaatggatgcctgaaaagttatggatggagacagttgtgcccttcctaataagcttattattttttttataatcaagccaatcatgttatactcgtaaatatattttaaagtacttacgttttaattctttattaacgtttcctaattattaaggtgaaatcaataaaaaaagatgatttatttattacttggtatctagtttatggtcctggtttgttttaaagagtatctccagaattttgtttagggggaagctgaaacttctgatgatggctacttcttacaagtagccatcaatgtttctctttggaatatctttgccatcaactcacaagttagataccaatatatctcggcacaatcacattgcttgaatagcaaactcagtttctctg

SEQ ID NO: 337 - DNA, 2704 bp, Leptinotarsa decemlineata
  Annotation=Sorting nexin-27; Tribolium gene name from OrthoDB database=TC000177; Blast E-value Tribolium Gene vs. Leptinotarsa Unigene=0
ttcatctattggttcattcaaaatgttagcgtatttcttttggttcaagcaaagatgtatttatgaaatccatcagaaattttctgttaaattacagaacatgactttcatatcatttgtcatttgttgacaaaatattttcaaaacatggccgatacagatgctgttggtctaagttctaatcgtatcgaaaacatgagaatgaagaacggtccacgagttgttactataaacaaaactgaaacggggttcggatttaatgttcgcgggcaagttagtgaaggtggtcagctgaaaagcatcaacggagaattatacgccccccttcaacacgtaagtgcggttttggatcggggggccgctgaattagcaggtatccggaagggagataggattttggaagtaaatggtgtcaacgtggaaggttcgacgcataaacaagttgttgatctcatcaaatcaggaggagatgttttgactctaaccgtcatttctgtaactcaacaggaggcagaacgtcttgaacctacagatgacagccaaatttactatgactatagtgaaaaacgatctttaccgataagcattcctgattatcatcacaatgaaaggtgcggggaaagatatgtatctttcaacatatatatggctggacgacacctttgttccaggagatatcgagagttttcgaagctgcataatgatctgaaaaaagaatttatgggtttcacatttccaaaattgccaggaaagtggccctttgcaatgagtgaacagcaactagatgcccgtcgaagaggtctggagcaatatttagaaagagtgtgtgctgtacgagtcatagcagaatctgatgtaatgcaagagttcctaacagatcaagatgatgaaaatagcatgagtcctgttgacttgaaagtattattacctgatagagaagtggttactgtatccgtgagaaaaagtgcgaatactgatgaagtatatgatgcagttatcaaaaaaattggaatgtccaaaaaaatttccaactacttttatcttttcgaaatagttgaatacaattttgaaagaaagctaaaacctagtgaatatccacacaatttatacgtacaaaactatagtaccgccacaagtacctgtttgagcattcggaaatggctgttttccatcaataaagaattgacgttgatgaatgatcctcaagcaacctcttatttattttggcaggctgtggatgaagttaacaaaggatgcattcatgcaggtgaatatctatatcaacttaagggtcttcaagacaaaactagagccactgagtatcttaagctagctcgcgaactgccaggatatggtgaagtcgtatttcctcactgtgcttgcgattctcgaaaagatggacacgttattctctctatagggacatgggtatcaaattgcaggcttgcagggaagatggcacacctgaaagtcaaattgttgccctagaatgggactgtttgagacagtgggaggctgatgaagaagggatggcattctgtctgaaatataataggccagataaatcccccaaatggttaaaaataatcactccatattacctttacctaatggattgtttcgggagaattatagaagaaagcaaatggcttgatactggtgactgattcctgcactctcttcacattttatcattatccgaaatcaactaatttgtaaataaataatttcataatgtacttcaaaactattactagtgttatcattgtgatcattattatattatcttaatttttttatcagctttgtctagtttcaaaacaataatttattactgattggattatattagtggatgtttttctttatatatttgtttgttaaagtatcggttacagtgtaatgtgttatttaatcaatgcacctatgtttagaaattgattttgcatcttcagatttttttgaatttattcgcctaatcaattgatatcggttgtgttaaaagctataatgtcaaaagtaaattatttgttagttaagttttttcagaatggggatacacacaaaaatgtcatgtaatctcaagttcatttttgaaactatccacatgtaacattccatataataattgtatattcattcctataataattgttgtcaactacaaactcttgaacctgcaaaacttaggtaatgaacaattctatcagataaatatgatttgaattaaccatttgctcattattttatagtgcaagttttatagtttcattgaagtgattaacgttgctacctataacattgtttttacctatcaggagttggcatttttgtgtaattctttaaggagtcaactatagagataacataaatgagaatcataaaaatgctactacttcttcaaatagctagataatagcctattcgcaaaatattctctctcttctcttgatatgccgaattcatactacaattactgataacaaatcatttgtactgaattgtagaaatcttagttcataattagtaaattgtaaagaaaatagtattatatatgtaatgttgaactgatttttttccaaaaattattagtgttgctctaaataatatatgtttgtgttaaatattaaaaaaaaattctaggagttttcattaatgtttggctgttatgcacgaaatttgaaaataaatatattatagtagt

SEQ ID NO: 338 - DNA, 1170 bp, Leptinotarsa decemlineata
  Annotation=Nuclear transcription factor Y subunit gamma; Tribolium gene name from OrthoDB database=TC002314; Blast E- value Tribolium Gene vs. Leptinotarsa Unigene=5E-1; Blast E- value Tribolium Gene vs. Leptinotarsa Unigene=0
atcctgaaatctatattacaacttcctataacaaaagacaaataaataattacaacattccaaaaccacaacgagcacttttaaaaaccttataataaaatacgttagttctattcagtatcagcaccgttattgctttgtgcaatataaacttgttgggtcccagttgtcgccggttgagcaacttgaatcagttgtggctgcgccccagtgccaatgggggctgtttgaatgataacgggttgggaagaattgccttgcaactgcatttttatcatctgaagttgctgaggtgtcagttggattggaatttgctgcacttctccattaggggtgacaatctgttgaatgatttgaacatttccttgttgactctgaggaatggtttgactctgttggatgatcacgggagtttgggtcgttgtggcagtaggtgaagaatctcctgtattctgctcaatagcactgacttgtactgtttgaagttgttgtggctgaacaatttgtatggttccttgaggctgtgttacagttgttgtagaacctgaggttgtggaggtattattttgttgcaaattagcatggtgttgctgagctaattggaaatagtagtggacctgatctggattcgatccactacgcgctgttgtgccatcctctctaatcttggttggttttatatcgtcccttggcacaatgtcgattaagaaatcaaactgatcatactttgtaatggccattgctatatcatttcgctgtaaagttcttctcttgttgtcttcggtatgaatccaagctctcaatgtgagttcatgtataaaaatttctgcagcctttgcgaacagcaaaggagcctcagcgctaatcattttgacgtcttcatcaagtttcataatcttttttattcgagccaaaggtagtacttgttgtttcagatccatattacgaatggatctgatttcgtccataacttttggccaaaagtgttgcaaagcttgttgggcttcgctttgagtctgagattggtcgtccacacattgtagttctgatttgtcttcgtttgaatctgtattaacaaaaaacaaagaagtcgacattcttcacttaattcagattgaaaaattgagcgccttcaataaccaatcagatataactcgtattattatgatt

SEQ ID NO: 339 - DNA, 1147 bp, Leptinotarsa decemlineata
  Annotation=Putative uncharacterized protein; Tribolium gene name from OrthoDB database=TC002622; Blast E-value Tribolium Gene vs. Leptinotarsa Unigene=7E-46
tatctaacagttttattgtaattcacagctttcaagctcttaggattcttcaacacacataaattcatgaagctaacaactaataatagagcttgtcccatcaactctttattcgaagatgaatatgaactgaaagaatttttcaatgcttcttcaactgtgattggttcgcatttaagtttccattcaagtccaccatcattttgcattaattcgttgactacggacaaagtagaaaccttttccttccctatcaaggtttcaaataacctagcaggtagttttggtttcaagaaaaaaactctatttttagcaatgctttgaacagtgttatctttccccacatttctcagtgatgcattgtgattcatactagtattcagtagagccagcaacattgatgtcaagtgcaatctgttgatggaacgaagaaacagtcgctacttgcctagttggactcaatggttcggtggattcaaaaatgtacacatcactgggtggtattctttttacaacatcgatcgcctgcaaaaaaatttctgttggcaacattttctttggaatagaactaaagtcctcataactccattttgttagtttatttccttcgagagataatctggcccagcttataccaattggactcaaatggataccagtagcagaattcagttcctcttctaatccatttagagaaggtgttactatatgttttactctcttactagcagtaacagatttggatttgctggatgtattactatcaactatattttcgttaataatatttttacatatcgtgttcaacatattttcgctaaacccatcaatttctaatatatcacccaaggagtgaaacggtcctttttgtttttccatttttcaatatcttttattttgctctgtgatattttatacctggaaagttgtattggatctgattcattcagagtatttaaaacttttgtactctcttcttgggtaatctttgactcaaaatagagtccatttgtagattctttagaagttattgaatatttcataagttggtagatattaagtttcggtatttttaggaatgaatttttcaaggcggacatttcgaaaattaatggtaacatccagaaaggtaaacaaaccttatatc

SEQ ID NO: 340 - DNA, 585 bp, Leptinotarsa decemlineata
  Annotation=Protein LLP homolog; Tribolium gene name from OrthoDB database=TC006452; Blast E-value Tribolium Gene vs. Leptinotarsa Unigene=3E-34
tgctaaattgttttattaacatgaaattaaatataacatcagtgaaacttgaccgtttgaaaatatatttaacttactagaaacatatttatattttgaagttcatcttcttaggccttcttagtgattttgccttttgacttaagttttcttttcttatttttccctttcttacactttttaattttccgtgggtgtaaccatagtggataagctccattttcatttctcaaagttttagggttgaacttctgtatttctgacacttccctatgatctataatgtttttttccaattgatttttctcgttaatttcttcaacagtattgaacgacaccacctgggaaatatctctcattgtttcatcactattagatgcctgaatgttgtcaattcctagagttttctttaatctgtccagttcctttttgccatatctctcacgttttactgctcgcatttttcttctccatttgcttcttatgctcttagccatcgtatataagtagttccaacaaacttctattatttctttgaaacaatttaacctttctaaaagtcgatggtcaagatcgacaagtgac

SEQ ID NO: 341 - DNA, 706 bp, Leptinotarsa decemlineata
  Annotation=DNA polymerase epsilon, catalytic subunit; Tribolium gene name from OrthoDB database=TC009600; Blast E-value Tribolium Gene vs. Leptinotarsa Unigene=4E-124
acagggcagaatgggagaagaagactgtctgtgtattgcagaaagtgtataaaattagaatgtacaagaattgaagaacaaaaacaactatttgtcagaaagaaaattccttctatgtggataccgtaagagcttttagagacagaaggtatgaatataaagggttatcaaaaaagaccaagcaagcagttgttgatgctgtcaaaggaggagatgcttctgaaattaaatcagctaaaaacagagaggtgctgtacgactccttacagatggcacataaatgcattctgaattcgttttatggatatgtgatgagaagaggggctcgttggcacagtatggaaatggcaggtatagtttgtttcacaggagcaaatattataatgaaagctcgtgagataatcgagcaggttggacgaccccttgaattagacactgacggtatttggtgtattctcccagcatcgtttccggaaaatttcactatacttaccactcacgagaagaagaaaaaattcaatatttcctatcctaacactgtcctaaatgccatggtcaaagaacatttcactaatgatcagtaccacgagttaattgatcccatcaaattggaataccaagtgaagagtgagaattccatttttttcgaggttgacggtccatacaaagcaatggttctacctgcaagcaaagaggagggcaagaa

SEQ ID NO: 342 - DNA, 2169 bp, Leptinotarsa decemlineata
  Annotation=Cleft lip and palate transmembrane protein 1; Tribolium gene name from OrthoDB database=TC008245; Blast E- value Tribolium Gene vs. Leptinotarsa Unigene=0
gagtctatattataacgtcacttggtatagacgtagatgacgtacgtagagaacaccatcagtctgtatttgtggtaatactgtagcttcttatttaacatttctatttttcacgctattcaaacacaagtcgtcagcaatcagtattaccattttctgtgaacaattaaacactttgctatggttcatattctggagtgaaaaacaagtcagaagatggtcgacacccaaagaactatgcctaatgtgaataattccaccagtcaaaatgaagttactcaaaatggacaacctgctactacccagccccaaagacagcctacaaaacttgaagcgtttcttgccgtagtaaaatctctgattgtcagaggattaattatgtatttcatattttcattcttcagaccctcccaaacccccaaaactggcgaacaagtagttaaagtttcccagaccccagccaaaaatatattttctgatggtacactaatgaatttatatgtttacttgtcagaaaatgaaactatggataactatcacaattcaaatttgttttggcttaaagagggattgaggtatggagattggacttctggccctaatcttgatggttcatatgtgatagaaaaagatgttccaattacagataatatgaggaataatggatccctctttcttcatgcctatttggtaagatcagggtacagtccggatcctgctgcaaagaattttgcaaaaaaccagatgtcatcaataatgaagcaattgaataggtataaaaaactgaaatctgctggtaccaaaaatctattaactggcgaaagtgaaaaaatcgaagttgaagatggtaagattatgtcccattggcatccgaacttcaccctgaacttggtcacggatcaaaccctatggaccaagggggcggttcctcctcctctggaccaatacatcagattcacagacgatggaaaagagtataaagctgtgctttttcctaacgacttctggaatatggcacgagattacaagcttctaaacgaaactttcagtcttcagataagattccagcctctgagcttatttaagtggcaactctatgctgcgcagcacatgagacagaattggaacattttcggggaaggcgaaccctctcagaccgacgaggaacaagatactcttaaggaaaccttattggacacgaatccgtacctactcggcctcacgatttgcgtttcgattgttcattcggtgttcgagcttctcgctttcaagaatgacatccagttttggaacaatagaaactcattggaaggcctctcggttcggtcgtgtttttcggggtgtttcagtcgctggtggttttactgtacgtcctggataacgaaacgaatactctcataagggtgtcgtgtttggttgggctcgggattgagttttggaagatatggaaagtggtggatatcaaatttgagaacggctggttgacgttcaaggataaaagttcctatgtagaatccagcacaattgtgtatgataaacttgctttcaagtatttatcgtggctttgctttcctctgctagggggctactgtgtatatgcgcttttgtatttggagcataaggggtggtactcgttcgttttagacttactctatggttatttactgactttcggcttcataatgatgacaccgcaattgttcataaactacaaattgaagtccgtggcccatttgccgtggcgaatgttgacctataaatttttgaatacctttatagatgacatgtttgcattcgtcataaaaatgcctacgatgtaccggataggctgcttcagggacgacattgtcttcttaatatttttgtatcaacgttggatataccctgttgataaagctagaaggaatgagtttggttattccggtgaggcagaggaaagtcagaagagcatttctagcaatagcgaaattccagcagtagaagaaactaagaaaaacaagtaatagtaattttgtgaataggaaattttagtaattgtttgttttttctccgcatcagtatagcgctattgatatttcattgtatttaatttatgattttgaaaataaaaacatctcgaacagttaaaaaaaaaaaaaaaaaagtaaaaactctagacgttagatacca

SEQ ID NO: 343 - DNA, 1837 bp, Leptinotarsa decemlineata
  Annotation=Pelota; Tribolium gene name from OrthoDB database= TC001682; Blast E-value Tribolium Gene vs. Leptinotarsa Unigene= 0
gattaagttcactggttgttatggaaataaaaatttttctcgaaacagactttcatttttgtaaaaaagatagtttatgttgaatatgttattatcaactaatatgatgaagatgctacttcttaaaatgccaatattcaaccaaaaaaatcaatttgattaagattttcttgtagcaaatataattacaatatttggatttcgattcataaaaaacactacaaaattaattatttcagcataatttgtaagttatattgaattctgaattttcgattcatcatttatttatctctggtatcaattattccaaaataatggaacaagaagtgttcaattatgtttcaatttcataattataaaaatattgattgaaggttatctttaaataaccttatacaaaataaattaaaaaatataacagcttcattctctaaaattacacttattacataaaatgtaaaataacaaagaattatataatatctcatggaaaggaattcacatctaaaatattttgataatttgctagtcttcatcactttcatcatcatcaatttccggcattgggaatcttaaaatggcagctactccggtcaactgatccagttgttctcccgagatgtgtaaactagagaatatcttgacatctccaccggaatctcttactgaatcaaccaattcaacatattccttgcgaagtttaacatcttggcttcgaaataaattatctgatatcaataatgattcaatagcttgtgctgcattagccttttccacatgtttcttaccatagaatgctttatctggttccagctgtagaattgtatagaaattttctaatgccttcacttcgctacttgctttagtatctgatattttgtttataactgctggatcttgaagaacctcattcagtgagtgcttgaagcccgaagatgtatgaaccaacatgaatttatgtttattttccaggagaagtttattatcagttttgactgcagtttggaaaagatactcacaaaactgatctcttacaaaacctggcgaagcaatcaatacacattttacaacatcaaaattaacatgtcttaaaattgattgcataacattgtcataaaattttgctaaacccttttcatgttgttgaacaaaaccctttctttttcttggtatgttcatatcaattttagctctcatcaaggtcatgctagacgttattaagcaaatttgagctagaccttcttgcattataacagcagcaacatcagcagtttttgtagggtcacatgccatttcaatacgctctagacagactgaatcccacagacgttttctcagagaaaattttctgttctgttctaaatccagtgtatgataggctcccatcttgacatactgattttcttctatgttccttcccttcagtctcagcatacatgcttgagtatcaaaatcgatattctctacagaaattgttaatgtagttctcactctgttggatgaagatgagcctgtggacgattcagtctggacttttcgaattgttgtaccccgtacagaatctcctacagatatgaggttgtacgcatgccacatatcttcaggttcttcggggataagagctacagagccctcgccatccctatcaatactctgatacaccaatttcattttgacgtaattctaaacattattccaaaaaaataattagatttggttatcattatcattatttttgggtaggtataccagcctctcacttaaggaactgaaataattttctgtcatctttcaatattgccattgccattttttttaatctcaaatcacagtc

SEQ ID NO: 344 - DNA, 949 bp, Leptinotarsa decemlineata
  Annotation=N-terminal acetyltransferase complex Ard1; Tribolium gene name from OrthoDB database=TC000030; Blast E-value Tribolium Gene vs. Leptinotarsa Unigene=3E-111
gtgcttatgtcatatgtcatcggaatatagtccatttcaaattgttctgacgaaagaggctggttcctagtgtggaaattcatattgaccagattcaagttagtcagagaacttataggtgaggctaatgacccggaggtaaacaatctaaaagcaagtcgtggtcgaatcaaaaaacctagaagatactaggaatctatttcaagatgaatatacgctgtgcaaaacctgaagatctcatgaacatgcagcactgtaatttactgtgcttaccagaaaattatcagatgaaatattacttttatcacggactcagttggccccaactgagctatgtagcagaagatgaaaaaggcaatattgttggatatgttctcgccaaaatggaagaggatcaagaagacctgaagcatggacacataacctctttggcagtaaaaagatctcatcgccgactgggtttagcacaaaaacttatggaccaggcctcggaagctatggtagaatgttttgatgcaaaatatgtctccttgcatgtgaggaagagtaaccgagctgccttgaatttgtataaaaattctttgaaatttgaaactgtggaaatagaacccaagtattatgctgatggtgaagatgcctattccatgagaagggacctttcagagttctcaaggaaaaacaaattgaagtctgatgagaagagtgaggaatagatcatattcaaaattatattgaatggtaaatcattttaaacatgaaatttcatgctactcttgcttcagatggtagtagtactgttagtagtacttgtaaaaaatattaaaatcagtatgtaaataaggtttcatcagtgaaattgtttttattttgagattttttgttggttttgtttagttattacatcttgtgaatttttcttaataaaattacataagtcagtctagaattt

SEQ ID NO: 345 - DNA, 842 bp, Leptinotarsa decemlineata
  Annotation=Topoisomerase III alpha; Tribolium gene name from OrthoDB database=TC006688; Blast E-value Tribolium Gene vs. Leptinotarsa Unigene=1E-165
ggtgaaaacatgtcatgcagatttccaaaatataaaaagaaccttagaaagagaaatcagatcatgtcagggtttgataatatggacggattgtgatagagaaggggaaaacattgggtttgaaataataaaagtatgttccgatgtaaaaccaaatctcaggatatatagagcgaaattctctgaaataacagcagcttctgtttttcgagcattaaatactcttggacagcctaatagaaatatcagtgatgcagttgatgtaaggcaagaactggatttgagaacaggagctgctttcacccgattgcaaacgttacgattgcaaaaagtttttccgcaaaagttagcagataaattgataagttacggttcctgtcagttcccaacattgggatttgttgtggaaaggtaccaagccatagaagatttcattgcagagcccttttggaaaatcaaaatgaatcatactgtcaaagatgtaacgaccgatttcacttggaaaagagataggctctttgataaaaattgttgccaggccatattagatatttgcaaggaaaatccccaagctgttgtggaaagtgttgagagtaaagagaaaagtaaatggcgtccgctacccttagacacggtggaaatggaaaaaaatgcttcaagaaagctgaaaattaatgctaaagatgcaatgaaaattgccgaaaaattatatactcaaggattcattagttatccacgtactgaaacaaatatctttcctaaggaattgaatttgacgaatttagttgagcagcaaagagatgatccaagatgggggccatttgctcagagaattataaacg

SEQ ID NO: 346 - DNA, 621 bp, Leptinotarsa decemlineata
  Annotation=Proton-coupled amino acid transporter 1; Tribolium gene name from OrthoDB database=TC000451; Blast E-value Tribolium Gene vs. Leptinotarsa Unigene=1E-63
cgaccgtagcggacagtaagaagatatccgcgatactgaaagagcacgatcctctggttttgcagaaacatctgctgtcgtctactgtgcagaatcaggtttttcaagacagctcgattctgctatcagtttggaagtcgaactcagggacaagctcgacaagtttaaggaggaaaatgaggatttgcgatttcagctcgaagacaaaagcatcgaactggaaggcaccagagcgagagtccgcttgctcgaagacctccaaaaacctctgaacaagagcagctcccccgacatcatccccgtgacgttggatacgacgccgcccggtcgaccaccttcgaggacggaaatctccacggccagcatgaaggccatgagtccgctgacgttgagcagcttgaaggccgtcgccttgaatatggatctctcgagcagtacagagtctgcgcacgatcagtcggcagagaaggagaggagggatagcgctgggaagtcgaggaggcccagcaagatcccgttgaaaaatcacacggcgcctaaacctccacaaggtaaacacagcccggcaccaggcacacgtaaccgtagcagcgtctcaccaggtagaccgcactctgcaca

SEQ ID NO: 347 - DNA, 1557 bp, Leptinotarsa decemlineata
  Annotation=WD repeat-containing protein 55 homolog; Tribolium gene name from OrthoDB database=TC013806; Blast E-value Tribolium Gene vs. Leptinotarsa Unigene=0
gatccacagaacaccgtacgagttttgtatcttcatggttaagttaaaaatcgaaatgcaattgaaatgtttcaaatatgtaataatgttgtgttagtttctaaaagaaaatagtaaaatgttcaagaaaaatcctgaaacgagtgaaggcgaagtaatggagaacgacgcaagtaacagtgagatcagtacgacacattcagaacagtctgaaagtgaaagtgagactgtgaattctactgtaaacatggaagaaataggattctgacttggatgagattcctcagaaagatgaagaggaagatgaaacaataaaagctattcgcagacagaatactcgggaaagggaccacccttccaacattcagtgtgaagaattcataactgatatttcctttcatccacaaaacgatattctagccgtaggtaatattgttggggatgtcctgttttataaatactccaatgacgaaaatattctgcagatgactctagagctacattcgagggcttgtagagacattgaattcaatcaggatggaaaacttttacttacagcctcgaaggataagtctatcatgataagtgatgtggagagtggaaaattaaccagattttatgatgatgctcatgatgtacccatatactgcttaactgtaatcgatgagaacttattttcaacaggtgacgatgacggcacagttaaaatttgggacatgagagaaaagggcacacaaatttataaaacaaagaaaaatgaagatttcattagcgatatgattaccaatgattcgaaaaaatatcttgtttgttccagcggggatggatcagttaccagtatagatctacaaaataggagcatttatatgcaatctgaagaatatgaagaagaacttacttgtctaggtatcttcagatcagaaactaaactagtgtcaggttcttcaaatggcaagctgtacttgtataactgggaggaatttggtttacacagtgatgcttttccaggtcctaagtcctctattaatgctttagttccgataactgaaaacatagttgtcacagcttgtgaagacggaaatcttagggcaacccatctgtttcctcataggcatttgggtattgtgggacagcatgacttatcagtggagaatgtcgacatatgtagtactggacagttcatagcatcaagcagtcataataacgacataaaattttggaacattcagtattttgacgactttgacaaagtcagccagaaacacaaaaaacacaataggaaggctgaattaaagaataatttaccatcatcaaaaattcgcaatgcttcagattttttcagtgatatgatttgatatcataacattaatttaagatagtttcaaataaatgacagtttttattttccattttttattattacagttagtgacaactatagatgagaattacatattcgaaatatgcaataaggtttaaggtatgaatatgttttagtagatgatattttcttcatcattggcaactttatgttatccttttctcattgtgctaatt

SEQ ID NO: 348 - DNA, 1407 bp, Leptinotarsa decemlineata
  Annotation=Nudt18 protein; Tribolium gene name from OrthoDB database=TC004374; Blast E-value Tribolium Gene vs. Leptinotarsa Unigene=9E-145
gaatgcaaaccttgaccagggtaagtaagttagtatatcccaaaacacattttattaatagttaccaacaaaatttcttgataatactgtggatttagttttattattactatcactgttccacttcaaaataataaataataacaaacatagtatttatgaggcttcctaaccacagatccaacttggatacttattgtgaaaaatgtatagaaaattcaacaagcaacaatttttatcgtatgacatgcaaagggaaagaagcatttctagatgccaccctctgaagtagatgatcacctaaatccttcgtggtttcatgccagacacattttccaataatgggaacctcttcaaggggcgacctaaaagctactaacaaagtgagacaaaggccatctttgtcagtcgaaggatcatactcaaccgacagtaatccatagggcctatgagcaggaacctctgctccgaaaagttccaccataaaccttctcagggtcgaatgcaaactttttgttggatggatttcacaaactggcaaatgccacgatgttctttcactcagaagaatatgaacgcgattagtagctttcttcttaattattaccactaatcgaagtaactgtttagagtaagccctcaaagctggcaactgatcttgaatccaacctggttcggagctttttttagctgcgtagtaaaccctggctctgtcaatcaggtgagttatatcactggctcgaagatctaattcattcacgttcttaacccatttagcttgtagtgactccttatcagcttctgctggagttttcaagttgcctccaactacttttccagttagaacaaacctcatccagtttcctcttgctgtttccaccatcagtaaagttgtacactcaatcttcataccagtctcttctagtacttcgcgttcacatgctgttgttatgttttctcctttttccatatgcccagcaggtaaataccatttgccagaacaggacttttttgcttcttgcatcattaaaacctcatcatgctcattcaatataacacaagctacaatgtacataacctgtttcacataaaattggtttatattttgggtccacactgggttgtattccttgtgattccagtgcttcattctgttcttctaaggtgaaatcacatatttctgcttcatcggcatccaaaggcaaaccctttaaaaccctctgtaagttttcctctactgaatctggcatttcttacttttcagttgactttaattatgctgaattccagaactgaaacatcttttcgaatttaaattatttaccgctgaaaggcctcattctatttctgcaaatatgggaagtaacattccattcatagtacaccttgcctatacccacccaagaa

SEQ ID NO: 349 - DNA, 1732 bp, Leptinotarsa decemlineata
  Annotation=Trifunctional enzyme beta subunit (Tp-beta); Tribolium gene name from OrthoDB database=TC008872; Blast E- value Tribolium Gene vs. Leptinotarsa Unigene=0
cagagtcaaagatcaaagtccgaagttcagttttcaattaatatttttaatgtctatgatctagttccgaagttctgttttcttttcacatcatttatttattgtccagttctttttttcggcattttcaattaatttcttgatattttaaaatggccttatattcaagaaatgttatcaaaagtccatttgtttcaagtatcttccaacagagtgcgctgagaactatttttactggaactcaaatcaatcaaaaaaagactttgactccaaaatttggtcaaaatgttgttcttgttgatggagttcggacaccgttcttgatgtctgggactgactatgccaacctaatgccccacgaattagccaaacaagctcttagtggtattctcaaaaaaactggtgtttccaaagagctcatcgactatgtcatttatggaacagttatacaagaagttaaaacctcgaacgttgctagagaagcagcccttgcagcaggttacagcgataaaacaccttcgcacacagtaacattagcctgcatttcatcaaatgtcgccatggcatcagctgttggcctgatcaatagtggcatctatgatatgatagtatgtggcggggtagaattcatgtctgacattccaatcagacacaatagaaagatgcgtagcctcatgttgagagctaacagggcaaaaacatttcaacagaaactagcactgctgaccagtattagacctaattactttgcacctgatctgccacccattgccgagttctcttcaggtgaagtgatggggcattcagctgacaggttagctgctgcttttggagcaaccagacaagaacaagatgagtttgctctccgttcccataccatggctcaacaggcatatgaaaaggggtatctcacggatctgatacccttccaagttcctggagttgccaaaacagtggacagagataatggaattcgtgtctccacgcctgagaaacttgcagcactgaagcctgctttcatcaaacctcacggaactgttactgctgcaaactcctcatttttgactgatggagcttcagcttgtctgattactactgaagagaaggccaaacagcttggtctgaaacccaaagcctacctacgaaacttcctgtttgtatcacaggatccaatcgatcagctacttttaggtccagcttatgcaactccccaagttttagacaaggctggactgacgatcaaagatgttgatgtttgggagtttcatgaagcatttgctggtcaaattctggccaacttcaaagcaatggacagcgactggtttgcaaagaattacatgaagaggcctggcaaatttggtgtaccagatataaacaaattcaataactggggaggttctttgtctattggacatccatttgcagccacaggagtcaggttggctatgcatactgcaaatcgcttggtgagggaagatggtcagtttggacttgtagcggcttgcgcagctggaggacagggtgtagcgatgattttggaaagacatcccgacgccactcctaattaaacattttgaattcaaaataagaaaaggtacctttaagaaataagtcttgaattctttcagtctctatagtcttatattgaagatattcttaattttattattgtgtattaagtttttatatcattgttattatttatattataataagaataaaatttacattt

SEQ ID NO: 350 - DNA, 1250 bp, Leptinotarsa decemlineata
  Annotation=Thioredoxin domain-containing protein 1; Tribolium gene name from OrthoDB database=TC002424; Blast E-value Tribolium Gene vs. Leptinotarsa Unigene=1E-89
gaaataaattagtaatggcgttcggcaaagtcaccttttgtataattgtttcaataattagtgccttcgttagtgtaaatggacaaaaaactgtaattgaactaaatgaggataattggagcgaaatcctcaagggagaatggctagtggaattctatgccccttggtgccctgcttgcaaagctctggaacagaaatggaaggaatttgctgaattgggtcctggattaggtatcaaagttggtgcagttgatgtgacaacttctcccggattgagtgggagatttattgtaactgctctgccaaccattttccatgtaatcgatggtaaattcaggcaatacaaaggtgtcagggataaagactccttcagctcattcatagaagacaagaaatgggagcaggtagagccagtgccaaactggaaatctcccaactcatttcaaatgggtgtcgtttcttcattcttcaagctctctcagtttttaaggcacatccataacaagttgactgaagaatatggtttgccgagctttgtatcttatctgatttttgccgttgccaccattttcctaggagccctacttggattggttttggtttgcgctatcgatctcatctatcctcccaaaagaacttcgtccaaaagtgaactgaataaaaagaaggataaagacagtggtgatgaattggatgatgaagatatcaaagacgatcttgtcgatgatgctgttaaagagtctggggatcacaattctggtaccgactcagaatcccaaactcctggaaccaacacgggcaccaaaccgaaaaagcgcaaaaacaggagagttgatatgtgaatttaatcgtgctgtatcaatactaaagctcatactaatgactttttgaggaacgaatttttagtgaaaaatttgtttggagtagattaatgaacgttacgtatattttttgagattgaagagcttttccagttttctcataccctgtaacttgactgagagagaaattgtatttggaaagagccgaatgttgtttgaatgaataaagaaagtacatctgtttatttattcgaggtgcacataaggacaataagttattgggctgttgaaattgttggtttcacggtaggttactctttattcattccagtgtttttgtgattatttaaggtctttaattgcttgtaaatttttataactgtacagatttctttctaccgttttctattaaaacacttataattcagt

SEQ ID NO: 351 - DNA, 1280 bp, Leptinotarsa decemlineata
  Annotation=Hemicentin-1; Tribolium gene name from OrthoDB database=TC009766; Blast E-value Tribolium Gene vs. Leptinotarsa Unigene=1E-68
gtatgtatgtgcaacgaggagtggctccacttcttgctgttttggcactgttccctatggtgtctcccagtttcaatactttggacgaaggatccgcccccaatgagctggacaaaccaatcccgatggattcgatcgaaggggtgcttggaagaaagcaaggcctaccctgtgatattaggccgaaaggcaaagacgacgccgtcgccatggtgttgtggttcaaagaaaccatcggggagcccttatacagtttcgacgtgagaggaaggcaattcactcaagccaaattgtggtcatcgcaggaagtgttcgggccgagagccttctttagggcgtccactaccccggccactctggttatagacaatatccaattatctgacgaaggtgtataccgatgtcgggtagatttcaagaattctccgactaggaatagcaaagtcaacctatctatcatcgtgcctcctcaacatatacaaatatacgatggccaacatgtggacaaatcagtattaattggaccctacaatgaaggttcggatgtcaatctcttatgtgaagtgagaggaggtcgtccacggccaagggtaatatggttcttggaaaataccataatcgatgattccttcgatatcagatccgatggggcaaccgtcaaccacctgtcattcccaaacgtcggtagacaacatttgcacgcaagactgatctgccaagccagcaacaataatatcgtggaacctgagacgaaagtggccgtactagatattaacttaaaaccccaaagtgtgaatattttaacgcaagaaaaatacgtgtctgctgataaaaggtacgaagtggaatgccggacttcgggatccaggcctgatgccattatcacttggtggaagggaaataggcctgtcaagaggctcgcaaaaaaacttctcggagcagaacaatcagagcctgagcattttgacattcgtgccagtgatcgacgacgacggcaaatacttgacttgtcgagcggagaatccgtccatccctgacagcgccctggaggacaagtggagattgaacgtctattatatgccaatagttacattgaggatgggaatatctctcaatcctgatgacatcaaagaaggagacgatgtttatttcgaatgctcagttcgttcaaatcccaaagcacacaaattgtcttggtttcataatggaatggaaatatttcaaaatgttacagcaggaatcatcatgagtgaccagagcttggttttacagaatgttgc

SEQ ID NO: 352 - DNA, 459 bp, Leptinotarsa decemlineata
  Annotation=Sodium channel, auxiliary protein, putative; Tribolium gene name from OrthoDB database=TC001707; Blast E- value Tribolium Gene vs. Leptinotarsa Unigene=6E-38
cgtatatctgatgacatctggtggcctctcgcgtgcaaccttcccgacacgaggaccacgagcagttagatatgccctcggcgtagatgtgctgtgtcgccatacaggtgaccggatcgggttcgtagtcggccattaaactagttattgctggatcgacgacgaacggtatcaaaaacaaaaagcgaagacagacaaaaaagccgtggttccgagacataatgacgtatagaatttagccgtttctgctatcgaaatgagggtgagttaactcttttcgcctagaacgctcatggtaattgctttgattatttacttatatgttatagaagtgccacaaatccaaaatgtacgctttcccctactcgatggatgcaatttttattgattactcgattcagtctcggtccaaaaggaaggggaacgcgtgattgatctcaaagtgccatgattgaattg

SEQ ID NO: 353 - DNA, 1066 bp, Leptinotarsa decemlineata
  Annotation=TP53-regulating kinase; Tribolium gene name from OrthoDB database=TC003335; Blast E-value Tribolium Gene vs. Leptinotarsa Unigene=1E-85
gaagcaacggccatagaaattagagagggagagaggcaaaagtaaggattgtaaggaagaaaaagtccctagtccttagcaaaaattaaaaaacagaatgtgataaatacgtttgaatcaaatacctagattaccaaggttttgactggattatttttctttgaaaaaatataaaatggaaggtcttgaattaataaaacagggagcggaagccaaactctacaaaggcctttatttgggaaaacttacgattgccaaggaaagattcgagaaaaaatatcgtcacaccaacttggataactgtttgaccaaagaaagaatgaaagcagagagcagagcaatagttcgttgcaaagctgctggtatcagaacaccaagtatttatttagttgatttcaagagaagaacgatattcatggaatacttccagtacagcatcaccgccaaagagttcatagaaacgatgtccgatgcttcgtcactgtccacactattgctcttttcctcagaactgggaaagctgctcggcactctgcacgaaagcaacatccttcacggggacctcacttcgtccaacattctactcgtaaacaaaaacaatgtcgagaagtatgacgatctcaacgaattagatttggttttgatagactttgggctggcacacatagaaaacagcgcggaagacaaaggcgttgatctgtatgtgctggagagggcgttactgagcactcacaaggttgcggaaagtttgatgcctaagattctggagagttaccggaaagagtacaagcaggggggtaaagaggtgctttcgaaattcgaagaagtcagggctcgaggtcggaaacggacgatggtgggatgagagttacttcataagctatttatgagttgatgctttgtaagacttgtattgtgattgagtataactttaatttatcgtgatacaaaattgacatgatattcaaagttttataagaaaaacttatttttttattacactgactaattgttgtgaatgagttatatttgatcggatctgtgtattaataacaggattgttatc

SEQ ID NO: 354 - DNA, 1623 bp, Leptinotarsa decemlineata
  Annotation=Vesicle-associated membrane protein 7; Tribolium gene name from OrthoDB database=TC007954; Blast E-value Tribolium Gene vs. Leptinotarsa Unigene=9E-17
cagtctcagaagctagttggtattctaacgtctagttagttactttttttttttttttttttttttttttttgttagagtttatctcagttttattataaaattcaacgataatgtaatcttatattctaatctatgaaaaattttatacaagtttaatatgatacaaataatatttacttagtatataaaattatttgatacttccaatgtaaaagagcatcattttgcgaacaataaaaactatatgcaatataaacatgagtcggtgtgaatttccttagcagtgagaatgaaacaatcaatgatataataaacaaatgttgtattactgcggcaatgatgtaagctacaaataaaaacagacaacttatctattcaatagatgaagtctatatatatagacgaggaaaaacccctctttttgtttcaagtgaaatacaattataaaattttcaggacagatgtgttacttgaagatataagtgatatacattgcacctctaagataatggagccaacataattctagaaaaatatttcagtcagtgaaaatatcttcatcaaatttgatagatttgacataaaaagttcaagttgcaaaattcatgagatgtcaacataggttcaactcgtcaaatattatttcgatatcatttatcccaatattacataaaattcatctaatgaattgataagaggaggtgttgtattttccttttcacagttcaaaaatacttttaatcaattgtttttttggtcggataaatatttggggaagttgaataataacacagtgtgaattttaaaatatcatttttaaaattacattttatttcttagacacacatccttgccagagtagtcctccacatgctaaggaaattataaaataaacaaccacagtaataactattcctataatcacataaatcttgacatttttccagaaaagtgaccgtgccagacttctactggttgtcctgaatgtcatagacccattattcaaattttctgctttattcactagaagttccaacctttcacctctcaaagctacattatctatattcttaaccattatatccttcagctcatttaattcgttatgaaccttgctaacagtgtcaatatcatgggattcagaataacgtttcatttcactggccaatatcctcgaaaattcagggttcattgcatatgccacagctgtgtttgcactagaagcataagcagattgaaatcgattttttatctcagtcagaaacaagaaggctcggctacgttcaaattcatcgtccgttatgcatagataaataatacagtcctccaaaatataatggaataaataatttccatgagaataagttagcttatcattctggggtggaattttggaaatgatctgttctgtaacttctacaaaattaccagtacatgttgcatatttagcaagaatagtttttgctcgactgataacacaatacaagataggcatcgtgtatccgataacaaacaccaatagataataaaggattttaaaaatttgattgtatctctatttactatttcttgaattattcatttcattgtcaccatctgataaatgtcattgatatgtctc

SEQ ID NO: 355 - DNA, 3078 bp, Leptinotarsa decemlineata
  Annotation=Epsin-2; Tribolium gene name from OrthoDB database= TC005393; Blast E-value Tribolium Gene vs. Leptinotarsa Unigene= 0
gaacagcatgcctcttgaaatatgtcatctttgtttgtctcatacaggtaacagattcattgtcctttattagctataaccaatgttgccaaacggtgaaatagaaacgaatccctttaaatgttgaatgcatcatttcattctttttttttcaagtatttaaataattttttaaagaaaaaggttgaaatgataagtttaaaatgcgtcgttttagagctcttttatgaaaactacgtgattttcgtcaggaggaacattccccattatgtgagctggcaaaacattacacaaaaccacagaggattatcgaacacttccataataccaatgaaatggaaaagttattcaaatattcattttcttttaaatccaacattcatcccttcgacaccccatgaaaacatcttctgtactcaacttcgcagtaaaagttcttctttcaaaatatatttttcaagcgcaaaaattcataacaattcctcaaaacacgagcagtgaccgagagtgaagttgatgtctaagcttcagagctacaacgagagtgaacgatgcctcgagaatgaaatgtgaaagcagataagacttccctctgacaaaaaattactttcgaataaaacacgtctcaaacaaattataaacctgagtctgcccatcacaaaaaaacaattgtggtttgtaaattatatagaaaagagtatttgaaagatcgatccacacctaccgtagcctggctttagccatcacccacagattcacatctcgcttcgaccccatgccgtttaatgcgtgctcaaacatttaatatatccgcgcaagctcagtctgttcagtgatttgaacaccgatagcaagcttcaaacaatcgaaataaatgtatttcccaataacgaattcaatataaatatagatatgtgtataatatatatatctgcaggaagtctctcgtaaaaaatacaaggtaaatgagcaaatatccaattaaaaaacgaacatacgagacgcttccgcaagcaaagcactccatccattataaaaatatatatgtatatgtcgcatttgaaaaacatccaaattgtatgagaaatcctcggtaaaaagtgttatcaaacataaacagcaactattatattttgcaccggccgtcttcgtcctttttatcaggatgaaattattcccagatccacttatcgactggaacaccaatctgcacccagcgctatgttaggacaagaaaggattagcaggttcgctaggcttcgtcatccaaggtgaattggtaccattcatactaggaacaggcgcccaaggatcctgcgtgacatttacggctccgaaggcactgccgttgctaccaccgaacggttggccaacctgttgttgggggaaacccccgaaagaggacggtactgtcggattcaaacctatcggcggagggacgaagcccgcagtagtcgctgacggggcgacgaaaggggcgaacgtctgctgcttgatttcgttgatggaaggtttcggaggcggagtgttgaagacaggcctcgaaggacttgcagcagcagcgggatcggagaaggggttagcgagcagagttgggtttgctggtttacttgtcactaaattatctaaattgaccaaggcagagttttctcctagaaaactcagaggagtcttcttagcggcagccatcgctccgtcgtcctgaggcaacacgtctcctaatagattcaattcgaaaggatcggaaactcgtacctcactggccccattcgtcttcggcgaagccgttctgttcctgttggtgatcacatcgaactcatccaaatcggtggagctctggctagtcggagaccaggggtcgtgcttggcgggcgtcgaatgcgttgcccccgagagaggcaccggggaagcggcggctacgggaagcggcccccaaggatccggcctctgcgaagaggctccaccaccaggaggggcccacgggtcggctagagtgggaacgtcggggggagagggtacagatgacggatgccaaggagatgactggggcctcggaggttgaggcattccccaaggatcagcccgcgacgcgtctaccaaattcacatccaacaaatccaccatgtggctctgtgacttatcctgctgcgtactcttgaaatcctgctgactttggctcaatgccaactgcaggcggacgtcgtcggatttcctcttctgctcctcctgctccgcctcttctcgagacattgctagcgcgagctgtagttgtagttcttcctcgcccgccgtttgaggcctagcaatttctatttctctcggcaaatctattgtatctctgctgctccagtcgccccgcagcgcggggaatttcgggctgctgggggtgtccaggcctccgtcgcttccaaaaccgctggcgctctgggcgaagcgttctttcgccttcaaggctcgcgctcgctcgtttttcagtctctcgtcatcttttaataaattgaccagttgcttggctttctcccttacgttcagtccttgatctttaccttcctccagatactgaaaatccttgagcgtctgtatcgcgaagatgttctccttgcactgctgccccaccttctccgagccggtcttgatgaggtactcgagcaggacgagcgccttgtagacgtgcctccagtttctgccgtggtcattcagcctcttccacaccatctgcatgatctcgctgaaggcgaccacgttatacgtgaggtcagcgatctcggccatgatcgtgctgctcggcccccacggatcgttcgatgtggcttcgcgcaccttcttctgcgcatccgagtagttgtgcgcgaagttcttcaggttacggcgcagaccggccacgttgacttgcatgtcgtgagagttccgcctcattttgaggtttgcttgccactgctgatgctgttagatccgagtagtttgctgccacttagagttgggaacggccgtacgttcatcaacctatagtccaccagatatatttcgggcgaggaatgacaaaacacaaaacggaaattttgaatggaataccttttc

SEQ ID NO: 356 - DNA, 1561 bp, Leptinotarsa decemlineata
  Annotation=tRNA (guanine-N(1)-)-methyltransferase; Tribolium gene name from OrthoDB database=TC011563; Blast E-value Tribolium Gene vs. Leptinotarsa Unigene=4E-1; Blast E-value Tribolium Gene vs. Leptinotarsa Unigene=08
aataattttttaattcacatgaaatgttctgagaaactgttttctacttaccttcggtatttcaaaatattttcaaaaggaaatcgctatatctccactgcgaacatattttttttctaaaatgagacctcctagttctgttagtggtttgatgcatttggataaaaagttgtttgaaatggaatcgcagatcagttatttatctatcaaattatcccagttgcaaaccatcttacccattatgaagaaatatttattgaagctagagaaacttaaacctgttcagcatatgtcaagtgatgaaatagaaatatatttgaatccaaatgttgtatcagactggacgagcttcccaactgaagttcaaaatcttttagaaaagatggcaataactgagaataatttattaagaaagaacttgacagtcaagtatgaaaattataccgcagaggaattattgaaagctattttaccaagtgaaagagaaggtatgtcaagctttacaaaaattggtcatatcgtacatgtaaatctaagagaacatctattgccctataaagaaattattggagaaattctctacgataaaataccaggttgtaaatctgtggtgaataaagtaaacatgatagacaatacctatcgttactttagcatggaattacttaaaggagacaacgatatgatgaccacagtgaaagaaaataactgcacattcaaatttgatttctctaaagtttattggaattccagattgtgcacagaacatgaaagaatagtgaaactcttgaaagaaaatgatgtgctattgatgtttttgctggtgttggtcctttttctatacctgccgctaaaaaaaagtgttttgtttatgcaaatgacttaaatccagactctttcaattggctgaaacataatgcaaagtctaataaagttggagaaaattatttcaaatctttcaacatagatggcagagacttcataaaaaacaacatcagacaaaatttgccacaacacctaatgaaaaaaacagaaagtattcattacaatgaatctacctgccatggctgtagagtttctagatagttttgtaggactatttaatgaggatgaacttccatttatatctgaccccattaccatttttgtttattgttttgccaaaggcgagaaccacattgatatagcaaaaaaccttgttatggataactttggacatgatgtttctgataaaatatctgatatattcagagtgaggaccgtgagctctatgaaggaaatgatgagagttactgttaaacttgatcgtgacattttagtggggatgtgtaaaaaaaggaagtttgaagacagtttccattcacagaataaaaaatcaagcatttctgatgggaaaaaaccacaaaaaagttgataaggtattcaaagtggctggagccaagagtttgaaacttaaagcaaaagccaaaactgttaaatctgaactgaaacaaattaatattaagaacaaaagtaaagtagctgagattgacaaagctcttcagctaatgcagaatactgc

SEQ ID NO: 357 - DNA, 2789 bp, Leptinotarsa decemlineata
  Annotation=Serine/threonine protein kinase; Tribolium gene name from OrthoDB database=TC012191; Blast E-value Tribolium Gene vs. Leptinotarsa Unigene=0
cctacgaacttttcaatccaattgttacttctgatttctttgaaatagctttctttaacattatttttcaaaatcatgaacccgtagcaggttctcgtcatgccaatttctgtgccctcaaaaacacatctatagaaattcagccaactcaactgtatataagataaagtgtggggctctacgtaaatataaaattttacccagatgaaggctctatactcatctttaaaacaagtaaaattctggttacatttcctgaaacatcttatcgaaaggaaaaccaatctacttcttatcaaagagcggtaatttggacctaacagcaccttcacatacaaccaacctagaacatttatgcctctgcggggtcaagtgtgaattcgaactagaagcccccgaattatgcttctctaacgatcttctcaaagctgctattcgtgagctcagttgcaatcctcccctcactcctcctggatgtctcaaagttgctcctttcttttcaaaatagtctactatagtcgaaatattaggctgcaaatcatttggccagtcagatccggcaagacttgatatatcttcactactatcggtgtatatcgaggaagcacgtttacataaggcgtgtaactcagcatgctgttcaagctcgtctagagacctcaaggaactcactgcggtgccactatcaccccagaggctatttggggataaacactcacctacactggagtaaaatccagattcacaagatcctctccttctgaggccagtaatagccgattctgtggtaaactccgataagttcgaactggatccgccttatacaagggatgtacaaaaagaggtgatctaattgttgtcgccttgcgagtagctgtcggtgaaccaggcagagatttgggtgattcggtaggctttattaaaggtgatggaatttcacaacatgaagagaaattaccaaggaactttttgacgccctgaaattgtacaagagcagtgaagggattggtggtacgtggtttgtagtatggatcttgccggcacatcaacaatgcatgtcgacgtgctttgtcacttggtgtaggatacattgaaagtgataacattgaagtgtcttctgacagagaccgccggtgaacaattttgcggtgttgtggagcacaggcttggacagaaatcaaaggcaactgttcttcactttttgcaacgcaactagctattcttgcctccttttcagctggcattttcatatcagtcagaatatcacttaacatcctcacattttcagtaaatgttggacgacttttaggctcaatagcacaacacctaaaggcaagcgtcaagaattcaggtacaatgttggaaccgcacagctcagaaaaagccagatagtccaggccgaaattgtctgttctgggcaaatagtcggggtcagcgtcgacgcgagctatcaattcgcagagtacgatcccataactgaagacatcgctgctttcatcataatatttgccattgagaccttcaggagacatccagtaaggagaaccgacgatgggtaatttagttttctcctttggatcggggatgttcgttgacaaaccaaagtctcccaccaaagcctgcagtttacctgaatcaagggctttgattaggacattcttgctcgtcaagtccctgtggatcacccctttctgatgaaggtactccattccggcggctatatccttggcaatggataccctagtcatttgctccaagtcgaaagttatatcctggatgacctgatagagagacccgacggcgatgtactcggtgagggcatggagttgaccttcgtgaacacaaactcccatcagtcgcaagatattggggtgcgagagacggttcatcaactggatctctttgagcatgttgcgcctgttcgaatgacgcgtattcatttttagcaccattacttggccggtatctgatgggtcaccttgaaaacttcagagaaaaaaccctcgccaattttttcttttatgaaagtcatcgaggcgatgcagagatgctacggcatgcttcagtgcttggcaagaagagcctgttttaagtctatcacttcggattctaggaggttcggaaagttcgttatttgggcagaacaacttttcataatcactgtccttagggtcacatggactgtcataaatacacgaaattttagatttagcagcggattcatttctctttaatgggtgcatcataatactggatcgaacaatcatgtagttttaaccaatttcgtacatattcgtgtacgataatgtacaagttcagtctttttattacacatacttcgaatttatagcggataaatcaaaataattttggtactatagttgttttcgagatcacttgacatgtcgcacgtcagattataaacaaactttcattaagttaatattacaagaatgaaatcttgatcgaacttaattttgcaattataacaaatattactgccttatcatgtatcgcattaagcctgttcagtttccgaattattaggcagataacttcaccaaaatgatgaaaagtacgtactatattaaacactcgttcactagataaataataaaaatcacaataaaatacacagtaattacactatccgcgaaaacaagattgacaccaaaacacttacatttacaacacctatttaatttgatgtacgaaacgtaaataaaaagtttgacacggcaaaagctttctctactgcaccgtcagctgccatatttccaatgagcagc

SEQ ID NO: 358 - DNA, 1018 bp, Leptinotarsa decemlineata
  Annotation=NAD-dependent deacetylase sirtuin-4; Tribolium gene name from OrthoDB database=TC014968; Blast E-value Tribolium Gene vs. Leptinotarsa Unigene=9E-95
gataacctatatctgtcaattctgtgaatattgttcacgagagataattttacaaatttgttcaaaataaatccaagattatgaagccttgacagaattactcaaatatgttcctaagcataatccagttttagcgcaggatattgaaaggttgaaaacattcatttttaattcaaaaaaaattcttattcttactggcgctggcatatcaacagaatcagggattccagactatcgatctgaggaagtaggattatatgctagaacaaaccacaaacccatccaacatttacaatttatcaaatatccagaagtgcaacagaggtactgggccagaaattatgtaggatggaatactttttctcaacgtcaacctaatgctgttcacttctcaatacgtaacttagaacttgatcacaataaagtatctactgtagttacccaaaatgtggacaaccttcatttcaaagctggtagccagcaagtaatagaattacatggtacagctttcagggtcatctgtttggaatgtgaagctacatacagtcgttattatattcaagaaaagattcgggagttgaatccatgcatgtcagaaatttctacaatgattagacctgatggtgacgttgaaatacctcaggaagaaattgatgagttcaaagctccattatgtgagtcatgtggaggagtgttgaagcctgacataacattttttggtgataatgtacccaaggcacgtgtacgaatctgtgagaaatgctgtatcggaaagtgactcagtgctggttctaggttctagcctgtcggtattttctggttataggataatactgcaagctgtggaagagaataaaaacataggtttgattaatatcggtcctaccagagctgacggactagtgaacttgaaaatatctgctaaatgtggtgacattttaccaaaaatttgttgaccagtgatgtgtttccattatgaagctgtaggaatgatttgatttcaatagactctagctaa

SEQ ID NO: 359 - DNA, 778 bp, Leptinotarsa decemlineata
  Annotation=Signal peptidase complex subunit 2; Tribolium gene name from OrthoDB database=TC013119; Blast E-value Tribolium Gene vs. Leptinotarsa Unigene=4E-93
gagtagtttgtggaatcgttgagcgtttgttgtggttggaaaaatactgtcacatctgtttttctctgattaaaactaattaaagaaaattaaaatggccccaaaggaaaaggataacaaagaaaaagtcgagaaagtacctgtgaaaattaataaatgggacggatctgctgttaaaaatgctttagacgatgccgttacagaggtgttaaccaaaaaatataattatgttgaaaattttgcccttatggatggaagattggtcatatgtggcatagctgttggtgttgcaatgtttgcattgatttgggactatttatatccttttccacaatctaggcccattttgatattcagtgtcaccacttatttcataatgatgggcgtattgactctctatacaacttataaagaaaagggaatttttgcagtgtgtatccagaaagatagttccaaaaaaggaaatacttgggaagctagttcttatttggcaaagtacgacgataaatataacctagttcttgcagtggtagatggtaagaccaaacagaggcgagaaacgagttccaagaaaagtgtcgccaacttcatcgatgctaatggcagtgttgtgaacgaattagtagaagctgaggtatcccgaatgcacaattctctcttgagtgaccgtaaagaaaaatgattcaagcacaaagtgtggatttttcatttcttttaagttattccatgttttgtattttcaagtaaaatgtttgattcagaatttaatgacgaaaaa

SEQ ID NO: 360 - DNA, 1599 bp, Leptinotarsa decemlineata
  Annotation=Transmembrane protein 18; Tribolium gene name from OrthoDB database=TC013466; Blast E-value Tribolium Gene vs. Leptinotarsa Unigene=9E-68
tactgtaaaagcatttatttcaacatatacaatacacaaattttccagtaatcactcagtcttatgtgataataaaaaataatcttaggtcctaagttcaacatccagtaaaaatatacaaaattcatttttcctcttttcaattgactagtcggaattaacagtttagtcgagattactgattatggcaaaaaataataattttttgtgtatgaaaaaaatgcaaagtacaaacatttaatacggaaactgctagacatgaatccacaccaattcaaacattatttttgtttaaactcatttccaacaaaaaataacccttaaaaatgttaaggctcatcactttgataaaaatatccttgctctacatttcaaagcggctgaaagctcaatgaacattatccatggtccaactttatatgctcatacatacacttcacataaactattttacaaagaacactggaaaacttgtatgaaacatttttataaggaacattattccaaagagctttagccagctaaaatcctaaatgtgtatccgacttcttcaaaaacgtattaaaacaagctacatttacccagcttgattcgttattactgcgaactactaactgtaagtacttgaaaatcgtttagtatgatttcagacaggaatctcggaaaaagcgtaaacattggtactcagcaaggctgtacactatcaccgatttttttcgttgctataagaaaacttcctgattcagaatgatctcaatcttcattatgaaaagcaacagttgctaaagtcgtaataatgaccgtggagtggatccgatctactatctcatgtacctaacgaggatctgctgaaattctggggtttgctagctttgcgacttaaaacgaatggtaactatcattatttatgcctttactttgtgatgatacgagtggaaatcttagtagaatgtcttaagcaaatattaatagagcagaatgtcgacaactattattcttccttcgctttgttctgtagtttgatttccttctctatcctcctctgttccctgagttgagccaacttcaggtttttcattagctgtgttgattgatacatccaactacccaccatcagaatgcaattcaacagtatcggcatggaaaaaaccactgatataaacagtccattgctatcgaaaagctgttgtctggaaaatatgttccaatttgtcgaagccagcttgtttatactctctgagaaatagactaataacagtaggcagaagaataagagagcttggaaatttccataatttctcgtcaaaatagccatcatgaaaatggaaatatggaaggtgaacagggctatgatccaagggtccttccattcaatgttcaataaaaaccaaagaaaactgtccaatttgttcacttcagcaaattcttggtcgatcattttaatttattatattctgttagatcacttgttaaagttggtcaataattattcactctctacttgaagcactatttattttttgacttcgattaaaaatagaaaacaaatgccaatggccactttgtaccaccgtaacagtgttggcaacctataaaaaa

SEQ ID NO: 361 - DNA, 2717 bp, Leptinotarsa decemlineata
  Annotation=Putative uncharacterized protein GLEAN_07747; Tribolium gene name from OrthoDB database=TC007747; Blast E- value Tribolium Gene vs. Leptinotarsa Unigene=3E-32
ataaaattgttgttcaacacaatttaacctcatttcgtgttttattttttcgagtttttagatttaaatcaccaaatggctaaaatagattcaacaaaaggtagtgaaacaaaaaaaaagtagaaagaaaaataaaggtgtaatatcgtttgacgaggaaactgtaaagaaagaagatgctgttgaagtaatggaaaggaatactggtgacaaaaattatggttttggaaaaagccacatcgaacccaattcagacgatatgaagcagaaaacacaacggaaaaaacagaaaaaatgcaaggtagctagtgatgctgataatgtgccacatcagatgaaagaagaaataccacattctgagatttccgagacggaaaacttagatcagtcaaatggttcagttaccaaaatgaaaaaaagaaaaggaaccgtgatgcagaggccaacggtgtaacaaacgaaaacgggaaagatcaaccaaaaaaaatcaagttatctgatgaagtagaaccaaatgcaggagataatcttaaaagtctggaagttgacctcaaaaaagactctaaaagatctcaaaaaaagctcaaacatgagaaactcctcgccgaaaagaaatcgaaagctgaggtggctacccaggaatccgttttgaattacttatcgaaatggaaacattgtcgtcaggaatggaaattcgaaaaattgaaacaaatatggttatcacaaaatatgcttgattgctcaaagattcccaatgaattttgggaaactgtggtggaatatttcactagttctaagggattcatcaggaaactagtgttgagggatgcactgaaggtcattgaggacgaagagaagttggaagatgataatgtaagcgaagaccaacggacaaaaatacagagagcccgggatatagtacagaatttacaagagtgatttgatcaattcaagaagtgtattgagaatagatgatgataatatgatagtagagcagagacttgtaagtgttccatatcattacattgacgtttaaataattgaaataaacaaatttggctgaatttcatgtcaagtaatggagatttgaaatggtgcattttttgttaatatgaaacctggaattgttttggtatgattattttgtctcttacctaatttaagtaggtattttgatgtttattttaaatatttatatgtgaatgacttttatcattaaacatttttttgttatgttatctcctcatttaatctcaacaatgttaagattgaagaaaaatcaatgtactagttaaaggatgatgtgaatacactttttaagaaaatcaaagttgttctaaacattcaatattgatattgttccacaaacagttggaaaataaagaaaagtataaaatatcaagaaaataacaataagacaatagtatagtatggctgtctgagacaataaatagatagtttcatcaacaatacctgttttttaagttcttcgagtgttttcgaacaatgctaaaatatgaacatattgtaaacagatataaagtcatgtgatggaattggaccgtacttgatgtaaattcaaagcttattcaaataacactttatcgtgtgattttcactgagcagtttacaaaacagcaacacgtttcgctatacaatagcttcctcaaacgtttcaagactcggtatgaaaaaataaatggtgtacatataagaaaataaataacatactgagtacagctgacacactgagtcatagccagtgataggctcatctcttaagatgtgcagtagatgtgtggaaatcagatatcagtgtattcgagccgtaaacatccaaattcaggaccatttttagttagtgatggagttcaaaagtaaattgcataatcatatgcaattttacgacccaaactttacgcagatacgatttctctcactggccatgatctagtccgggaactgtatttcattcactataaaaaagctactgtgatagcgaaacgtgatatttttttaaagtaaagtttgtgaaaaaatatctgttgaatgttgtacataaatcaatgatattatgacattctataaatttcatttgtgggaaaatgctttttttttgttcaatcgcaaaaatgagggttaaatcaaagtacctgaatcttccacaagttccataatttcttattcttttctcagtgacattttgatgtatctttggttcctccatcttgatgcaaaaaattgtggtgaatttccaaagaaagaacgtaatcaagttcaatatgtactctttacaaagatttgtagatcatgcatagatactttcagatacaaactgaaaaaaaaaggccttctgaaacaactaatttcatgaaccttgaattatatgaaaatcactttttaccatttgtactccaaataatcgttagggaattggaagtaacttctatacatgatctgcacatctttgtgaggagtttatatggaacttggttactttctatgttccgtcggaggttttccacaattttttgtaaaatgatggggagtagaacatcaaaaaccttttttacaaaaataaagtctcaaaaatataccccctttcaattgaaaaaggcttatgaaaggttataaagatggtcaataactatatagaattttttattgaaattacagtgtataatttatatgagtatacaataaattgcttcttatct

SEQ ID NO: 362 - DNA, 2695 bp, Leptinotarsa decemlineata
  Annotation=Nuclear pore complex protein Nup107; Tribolium gene name from OrthoDB database=TC011645; Blast E-value Tribolium Gene vs. Leptinotarsa Unigene=0
ttacaaatactcaagtaaacacaagaaaaaaagaaaagaacatttcaagcagaagcttcaattccccaggggtcctttctcgcgttcaacaatgccaccgaactttcacagagtttttctaggattttggcaagatcttcttttgaataaaccttataaattccgtgtttttctgatgcaataatatctgccaactggacacactcttcatgttgttcagtttcatacatgacagcatacagaatcaaaactgtttcaggaatacaaaccgatcttagaaactcatcatccttggcacccactaaccatccctcaggaaacagaagaacattataaagttttgttttagcactttttgctagatgtgtagctgtcaatttccacctctccaactccgccttatattgagattgtctatgttgatgagcaactttctcaggaaactgagcactttcacgcaggggttcaggaggggatggtttacatttgctatgtttaaaccaatcattgaaagcttcatgaccatctaagtaggctttgtaactcaaatattctttgattacttgatttttggcatcatcaacttcacctccgctcagaattttttccaaagagtctgtaggaattttattgaaagccatgtgtgctgcatcaattttaccgacggttaaaaacttaaatatcaaagaatttatttgtttcaatgcttctagtaattgaagttcataaaaaagaatccaatccaaagctgatattttgtagtgatccaattctgtcattttattttgaatatttccagattgttcaagttcttgagatatattaataacattctccacaatttgttgggttatggcaaagacatctaatccactctcctcggcaaatatcaaggaagatttcctctcctcgttgtttacaattttttctaaatattttgaatacatgtaaacttggctactacgactcactttacttacatagtaagccactaattgggtttcttgcattgtcatcagtcggttgatataagattccaatactttttcaacaacatctctgttatatccttgccctacctgatcaaaaaataaaacaagatgggcaaggaatctcaagaacgatgttgataaatcttccttttctatccattcttctattttcccaagcaatactggtatttcatccaagattatgtatttctgaatgatatggtcaggtcttttagcctcatttctgactgtggcattcttagaggcctccaaactagagaagacatcattaagggacatcctttgagaccagtattcatcaggtaaatccaaatatttgctatttcttataacacaatctctaacttcagattctactcgtacatcaactagagttttcatatatgcccacaaactatcctcccatgattgacacacaggaagaagaccattaagatatccacaaaacgtcgctactgcagccctttcatatagattgagatagtcctgtttgcaatatttaattgccacattcttccaaatgtccctgttgctgttcccttcaatatccttcacctcgtttgagtccatttcttcataaccatcatcaacgtcagaactagattcattttcaaactggtctttttgattgggatcatggaaaagtctccagccttctagcaatgctgctttccaggagtgtccagactgcctacagagtttgagggcctcctcaagttttccacttctgatctcagaaaaaactttcttgctcagtctcttgtcatcctctgcatccaaattgtgcaaaggccttctttcgtggtttggtgcatcggggtccatgttagtgatcgtctgtctagaactaccaaaagcaatggtctccgctgactggagttgatgcagagtgttttcccatcccacggtattgtctgaataaaagattacttcttcatttctctctgttgagttgcgttccagccagtcaattatgagctgactttccctaaccaaattgtcccatttgaataaattctggacgcagagtttttctgagcgacccaagtattgcatcatatgtccatcacccatcatattttgtgccaacaatcggtcttgatacaaaatgaagagaagtctccaagtattcctttcctgttccagacttgtttcctcttctagttgtgaaacagctattttggatttcaaactttgtataacattaagagcatcaccacaacatcgagacaaatcggtgacaatttccaatatattatgacctgaatgggtctgcaaaacctcaaaaaactccaagtaaagcctatcgattgtagttttccaaggggtattattcgcttgcagtacattccccgtaacagactgatcacgaagaatattagacagttttggggtggcttcttccataaaggactttttcattacatgatcttcaaagggtgggcaaataacttccgcatctggggctctttggaaactgcttttgaataatcctctacctgacaaagacagagcatcctctaggagtcgtacagatctttcaagatcgttatccattttataaatcaaaatcaacttttactgtactcttaaccttatcttatttataaaatccaaacatagcttttaatttttattttaacctaaaatacaacccctcaagctgttagaaagagagcact

SEQ ID NO: 363 - DNA, 3077 bp, Leptinotarsa decemlineata
  Annotation=Oligonucleotide/oligosaccharide-binding fold- containing protein 2B; Tribolium gene name from OrthoDB database=TC003641; Blast E-value Tribolium Gene vs. Leptinotarsa Unigene=2E-89
tttaaagatgggtgtctacttaatctggatttatgcaagcaccccagcttctctcaaaattaaaattacctctctttgttaacagaataaaaccactcttgttcaaacttgggaaaggaggttgcatgaatccagattctctgtaaactctttggaaaaaccttttttttgaatttctacgtcttcctcaatgtataaataggaaactcagaaaaaaaaacaaatgtcaataaactcttctagagaaaaaatgatgggcagatagatgtttctctcaaacataaactaaaaaaaaaagatgtcactgtcaattttgactacttggtggcaattttgaccacaccctgtcaatcttgacaactgcctttcaattttgacattttctgtcaatcttgacaattccctgccaattttgacccttctctgtcaagcagtaaaattctgaatagtctaaacgatgattcattcaagtcatgcatgctttgtgcacatttaatgaacataaatctatttcacacctgacaaattaaaatttaataattagacgacatttattttatgttgtgtatcttttgtacttgaaagaaacatctacattggtaaatattccggttttaacaggttgtgctattatttgaataaaaatcattttgttagacctacctattattgtctcctgatcacgaataaagagtcaaaatttggcactttggtctacttttggatatatggccactcaaaaagttttaattttcaaaaaatcaactagtaatgaaatcttgtaaagcatatcaacacaaaattcccattccttatattttcaatagccatatgaaatttgacagcactgcatttaattccagtttaatttggcaaaactgtcaacaaaaccaacaaaaaatccaagcacttagcaaggaacaactatgaattattaatcagcaagaaataagtagcacaaaagatattattcatatattgataggggtaaattttaagattaatttttcaaaaaaaagggttttggctttctacttcaccatcttcatacaaaagaaaggaaagaagccatcaatttcataaattatctctatataaagtcaaaaagttgactctatatagagttgatcaactttatataaagttaattctgaaattgattgaaatttcaaaaatttgactatatatagagtcaaaaaattgactctatatagagttgatcaactctatatagttaattttgaaattgattgaaatttcaaaaaattgactgtgcatagagtcaaaaaattaactatataaagttgatcaagtctatatggagttaatgtcgaaatttcaaaaaatagactctatatagagttaattttggaattgaatgagagttgatcaactctatatagagttaaatgaatgattttttgtatcaagatagagtagtagaaagcctaaaccgttctttcccatggcattcatgttttcctaattaaaaatcacaatggagtaaaagcaagcagttgagtctttagattttatttgaagaagagaaatatgtgatatcaactggtgtatgtgtatttgataaaaacacctcagagaatttctacaatctgatataaccaaaatgaataatgtcctagaagtcaccaaatatattacatatttttgtcatcgtcaatcttcatcatcaattagaaaaaattgcagaagcagataagggaaactaataatccgaaaatgttcaggttacattatacctcattatttctgtctgtgaattccaagaattttgaagtgtttgaggtattcaatgacagcattcaattatttcaaaatattgatttgtttcataaggattgaaaaaatgccctgcacttttttaattataccattaattgatctttagtgattagtgattgaaagtgcgagtcataaacatttgaactagtatcatcggcaaaaaaagaaaatgatacaatgggaaagttgcacttaatatcattgacatagatgagaaatgaggtagggctgtggaacccctttcacatctgctttgcctgattaatgattcgttttaagcttattttgaatgagtttggatcagttgtgaaccatgtcaataattgattattcgcaatatatctgaaagaaactcggctatccttgccaagttaaacttcagatttgtgaccagcagacaaaaatacacacgcccaatgaaacattttttaaaacctagcaggggctgttaaaaccaatattcacctgttaatactttccaaatagtttctcggacacttgtcgatttctttttccaaatttttggacgtttcctattctttaaacattgtcagagaggcagaaatccaaaatcagtgtcttcacaattccaaagtcggtctcaaactctcattacgttgctcggttatgtctatttctgtgctgccctgatctcgagccccgggatcgtttctgattgtccgaaggggggccatttccactctgtcgagaagtactgttcgcagttgtcttcgcaggccctgcgatgttgttgtgctgcattgggggtggagcggtaacaggaggctgcggaggcccaacccttcccgccccgttgttggttccgttattcaaaggcaggttgttgggggggccgcagacgggaggtatttgaggtaagaccggtccgggttcgctcatgttgagctgttcattgaacaccatgcagaattcgcctattttctggatgtcgccccctttggaggtgtacagggtgaggcagtttctccacaacgatacgtagcctttggtcaatcggactatgtcgccagggatcagcaagaggcctgcctcgtcccagatactggcgtttatacacgcactttggtcggccactttgaatgttcgaacttcgcggttttctttcgtcactgtggggtgaccgacttccaaaactatgaacactgcattaacgtttttcagtcctggacgcatgtcctttatttggatatagttattgtccatcatgaagactggaacaaaagctttttgaagagccttcttgtcaacctaaagat

SEQ ID NO: 364 - DNA, 525 bp, Leptinotarsa decemlineata
  Annotation=Proteasome assembly chaperone 4; Tribolium gene name from OrthoDB database=TC009467; Blast E-value Tribolium Gene vs. Leptinotarsa Unigene=2E-35
gaaagttccttatttcatcgaatatccttttttcaactaagggaatcaacctcctatctggatctatgttacagctcaagaacaccactttgtttgtctttttcgatattttgctggccatattcttggaatattcctcggtgaagtttcctacgagtctagtgcttataggcaatgtatcatagcgattcttcatagccagtgacaaatcattgaatttaatctggtctgcatcgtttacatacaggaaaagggattcgttcatggcgatcgactgaaaaaccaattttctctccagcaattcgtctctgaaaacgtgcacgttgaagtttgatgcgacatactgaatgctgagttcagggggctccatttagagttaagtggaacaagtcagtctgttgaaaaaaaatctattatcttgaataagcaatgtaaacaaaactgatttttgaaaataaacttgctatttttttaatcgtacttaaaaacaatcacagcgctacaaactacctcaaaacctatcag

SEQ ID NO: 365 - DNA, 1992 bp, Leptinotarsa decemlineata
  Annotation=Enhancer of mRNA-decapping protein 3; Tribolium gene name from OrthoDB database=TC008899; Blast E-value Tribolium Gene vs. Leptinotarsa Unigene=0
gatggtgaactgtggcaacgctgcatatatactaaaatagatcaatgggaaatgggaagacaaatccacaaacaaagtagataaacaataaaaaaaagtactattcgctataccagttctagttttcagtgagcagctgttctatgtttattatattaataagtgggaaaaagaaagtttaaaaatagggcccacaagaattagaaagttcaaaaggagttaagtgaaaccatactctataatatttataactgtatttgtatatactttttgcattatttctgaaacgttgtgctaaattatttataaaaaatggcacagtggattggatatatggtttccataagatgtgccaataatcttggcactttccaaggagaaattctttctgccacaaactctgtcattactttgacaaaggcgttttgtgaaggctttccttgtaaagaaagtgaagttcaaataagagccaacaatattattgacttgaaacttatagataaacaaacagataactccgaagcagaacgcagcactgttactatagcgaaaccaatagctaaaagagctggacgaacacacagcacttcagatgttcacaatgcaagtttcaacaagctttcaaattcaaatggaggacatgtccataacaaaacgaaacccattgacattgagatcaacaacaagccttctagcgaatctttgtctggttcttacaagaacaacaccccgaacaagagagacaaaggcaaaggaaaatggataaaggggtggaaagacgaagaatgctttggttcccctctggaccaaagcaacatcaataaagattttgatttcgagaagaatttggcactcttcaataaacaagctatctgggatgaaatcaattcgcaaagaccggacttggtgaaacctggcgacaataagaagccaacaaagtacaggcacgatgagaatgtgatagcgactttaccaacgacgtatcgtcagataacagtacctaggcaagatttttgtgagtatgttactgatgatggtctgattataccaagtatatcaagaccattaaggaagaagttgtgggaagtggcagatcgagtagggctctctagtgagaaacgaattgagttgatcggcagagctgctactgaaatatcaatacagcttcttgggggtggtcacaggttgaacccccataatacccatcagtggccaacagtggttgtattatgtggtccacacagacaaggagcaatgggagttaacactgcccgacaacttgccagtcatggggttgagaccatcgtctatacagtctctatggacgcccccattatgaaaaaagaagtctccctctacatgctcactaaaaacagggttctgaaccaggtctccgatctgcccaacgtccccgacttgataattgtcgccctctgcgaagacacggaacaccccaaacactaccctcttctggccgaatgggtaaggaagaacaaagcgcctgtgttggcgctggatccccctacagccggaactcctggcattactccaaagttttcattgttacctgtcttgccactgcctcattcgtccaataacgggaagttgtacctttgcaatttgggttttcctgtcgacattttcaatgaggtcggcatcaagtacaaatcaccattcggaccgaagtttgtcatacccctgcatccgagggacgaatgactttctgaaggaatttcatagttattttgacgataaccataacaaggatcatgcagtgagctaattcatttttaatttctttttttttcaaatcgtcctctttgagcccattatatctgttacagaataaaaaatgagaaattattttgtaagggaacagataatatacttatacctctttcattaaatgtttttttaattgacgaacaaaaaaaaaaaaaaaaaaaaagtactactagacgtttagaattaccactgacttctgagactgcc

SEQ ID NO: 366 - DNA, 1949 bp, Leptinotarsa decemlineata
  Annotation=CG8600, isoform A; Tribolium gene name from OrthoDB database=TC006991; Blast E-value Tribolium Gene vs. Leptinotarsa Unigene=2E-55
atactgacaggcgacagttgcgattgatataagtttgagtttagctctatagactgaaatcataatacgtatttttgttattgttttccgtttgaaatttttcaaagttaggtcagttgagaaacgcccttatgacctgcaatgtcttcagttctcgatgaaagagaggcttatttgaacaatccttacttcaagaaacacgaatacggtgactttacaccattttacattatagtaactgtttgttcagtggttggattttcaatattcctactgaacattattttgggctgttgctccaggtattcaggatattggaacgataggcacacaggtaaccgctggatagcttcgctttggtctgcaacacctcgtaatcaacctcctttagattacactgaattgcaagatatttcagtatctcagcaacacgtggtgtatcaccatccacctgctactcctcctcctcaagagtttttagaacttaagaaaagagaaagtgacatttaaataacttcaaaatgtttcatatcttttggccagctgtgtcatgtcttaccctatttctcattgtgggtgtcatcatggtcttattgaggtggggtcctagaatttgccgcaccagacacactactttaccagaaagagtggactggcagcacaaaatgtatgagcaccctattcagtattcttgaagaattgggtaataattttatacatgtcacgccaataaaagtgggggaaggattactaaatcagtaattagtatattcttgtcatcttatattttaatgagtgtagtattaactttattttcattaactaaaatcatatttactagacagcactatactatatattttcaagaaaaatgtgggtggaattaagattattgtaaaatgtttttactaatatattccagaagattgtccaaagttacgattccagagcgcacattcggcatggttgaatgcaggttagctatggggatgaggagagcatctctggctggtggatatagttagtatccagcagctatggaagggcgctctttctaaaatatatcatatctgtgatgtctgatggtaattgcagactgactgttgatgaggtcctcactagattgaaggaaatgaactgtggtctttcaaccttgaagtgcacaattcttcacaaggaattttcaggccttggtagcaagcacacgtgacacacaataaacccttacagtggagggataaatagaccacccactttggacctaccctacctactaatatgatagaattggaacttctggcgtagaatgtatccaacaaaatactttttccatgcagtaaaactgacacttttcttatagttctgtgatacttttctctgaaaaatgtgttacagttctgtgacaatattctcagaagaatatagtaactatcttatagatacttactatattgcattactctgtagcaataagagaactgaatcgtgaatgaaacggacatttttctgtttattctttgacatttaattctgaccataatttcaatgtcctcatattcagagcattgtctgaaaaatatcagttttaaattacattaatgtgtgctatataaagttcactcataagttatacttcgatttcaatcttattcgaatattgacattatttggtagtttttgattttgacatcctattagggttttttcttcaatattaaatagtaggtttcgagattactacaacatagcaagtgttaattcaaaaatacattattccaaaaagctgtttgttctccaatataaacagaaattataacaaatgatatctgaaaatttaactgtgctgtatgtttatgtgccttcttcagtgaatctctttccgtccatttttatactttttatactttgttactttacataagaaataaagactatatgaaagaagttaa

SEQ ID NO: 367 - DNA, 2627 bp, Leptinotarsa decemlineata
  Annotation=Peroxisome assembly factor 2; Tribolium gene name from OrthoDB database=TC002647; Blast E-value Tribolium Gene vs. Leptinotarsa Unigene=0
gaatttcgttttagcaatttgaaaagtctccatccatttcaataaccaatgaaacaattcatatcagataagttggttcatatacacaattacattcattgatttgatccaagttccctcttcaacttttcgaaatatagtaaatcttcagattttatggatggcttgacattcatcatagcttccccaaaatcttgaaaattaacaataacatcttggccgtattcagaatcgatttcaccgttttcaattctcttgataagtcttctcacagccgatgaccacgcactagaacaaattccataaaaatctgcccccgttatattcttcggactgattttcacaacttcgattaaattgacatcattcgagagactgaattttcgtgtaagagcctttaagactgaaagtttcgattctttatctgtacacggaccaatatacagtaacttgtcaaatcttccgggcctcaggagagctgggtcaattaagtctggacgattcgttgctccaatgatgaaaatcgttgctgaatcattcaacccatccatctcggctaaaagttgtgagacaactctatccataactcctcccgaatcaccggatatccctctgttgggggcaagagaatccagttcgtcgaaaaatattatacaaggtgacgcctgtcgagctctttcgaatacttctctgatattttgttcagactgccccacatacatattgagcaactctggtcccttcacagacagaaagcacaaattacattcagtggcaactgctttcgctatcaaagtttttcctgttcctgggggcccatagagtaatatacctgatctttttagtccagaatttttcaaaaatgaaaaaacaggatgtctcaagggtaggtatatagtcttttttatttcttctttcacgttgctcaaaccgccaacatctgaccactgaactttgggaacttttggggcccctaaactttcattatagttattctgcatataatctattgcacaaaagaaatcagtttcgcagatatcagttttatcagattgtgatgtgcgttttcgtaattctcttctcgcatgatatacaagcgctctgagatcttcatagaaaaaaccgtgggttttgttagcaatttctgacaacatgatatccgtgttcaaacgttcctcttccaaaatccatctgagattatgttctcgttgcaattctgacggggcaccgatctcaaatgtttccaaaaatagttttcgcaaattactgggaatatccttctggttgctacagcaaaataggaaaacaggaaagatattattttcgaagaggaatttcaattcgtcagagaagtttcccattatacgttcgtcatattgcccttcactgttcttcccaaaactctcaaaattgtgaataccgataatacatggagcagccatttttccggtgaagagaacgttatgcagtttcgattcattatgagcatatacattagcgcttaactcataattatttatttcatagtagtgcattcctaaacgagcagctagacaagaaaccagcaatctttttccactgccagcattccctaccatcaagaaggctggatgtaagttaacttttcttttccttaaaaatgggcgaagtgctacctgcatgttttccagatgatctgatagtccgtagggacatgttggaatttccttaatgactcctccttcctgtccaacgaatttagttgatttctttggtagaaaactttgaatattattactctgctttactgcggtctcaccaattacacaataacaactcttgtctatatctacatttcgatacattacactattacatttgaaataaatattatggacatttttcagtttgctatttagaaaatatagatcactggcaaaatatttcacatcgattgatattatatcctctttatttattaatttaggggttttgaaatatctctcagaattgaatcaattactgaattatttatatcaaaaggtgagtttatcaaggaaatattgatttcatctgcaaacgtgacattactgcaatgaatgtttagtaaccggagaggaaatctgaatccactattttccaagttgtaatacaaatcatcagcaactagcaaggtttcagtatcattgccctctgtggctggaacaacatgaacgtatctgctgcatctgttttcttcagaaaataatctgagaattttatcacttttatacacattttctttctgcactataacgatattattaacatcattacaattattattggattttataaaatgtctaataacttcatctgatacagacttcaatttgtatttaatttttcttttcactatcctagaatacaatatatacatataaaagatgaaccagaatggatgatacttaggatagattgtcctcaaggtagagaagagagcactaacatagcgatcgtattccaatttcatttctgctttgactatttcatcggtattcattttgtcacattaattttctaaactaacaaaaacactaacgaacttctcaaagtacacactcacaatatctactcaaaaagtgaggttatttatcatttctgtactc

SEQ ID NO: 368 - DNA, 1196 bp, Leptinotarsa decemlineata
  Annotation=Geranylgeranyltransferase type I beta subunit; Tribolium gene name from OrthoDB database=TC004960; Blast E- value Tribolium Gene vs. Leptinotarsa Unigene=4E-1; Blast E- value Tribolium Gene vs. Leptinotarsa Unigene=09
attattaaggttaatgaatggaaagaattttagatttatggaaatactcaattttgaattttatgttaggtgatttaaaatatgagaacgacaatgcactcattttcagctgacttacataaaaaatatttatttttcattttgaatggtaagttaccatcggcactgaataatatggacacaaacagatcattactcttatattttgctatatcaggattagatgttttgggtaaattgaatgaactaccaatggaacaacgtgaatccatcatttcttggatatattcattacaagttgttaatgaagaagacttagtaagtggcttccagggatcaacaactctgaacacagaggaaaataaagaaaaaatagtatttataagtattcccatattgctaatacctattgttgtttagcaacgttgctaatcttaggtgatgatttgaaacgagttaatcgaagtgccatattaaatagtttgaaaacattacaattatccgatggatcatttaaaggagccaaacttggtgtagagagtgatatgcgatttgttttttgcgctgcctgtatttcctatattttaaacgattggtcaggcgtaaatgtagagttgatggttcaatttatattaagaagcatatcctacgatggaggtattggccaaggacctgaattggaatcacattgtggttcaacgttttgtgcgatagctgccttagcattgagcaacaatttggatagattgacaaagccacaggtctcagctttacgtagatggctactctttcgtttcgatggaggatttaacgggagacccaacaaaccaatagacacatgctattccttctggacggggggagccctgaaaattttggaatcttatgaattcataaagaatgacaataatcatcaatttatactgatgacgcaagataaatatggagggttttctaaatggataaatgttgtgccggatccaatgcacacatacttgggtttagcgggtttgagtctgatgaactttgaaaacttgaatgagatgtgcaccgagttgaatataacaagaagaacttttgaatacttacaatgcattcaaaaagaatttttaactaaatttgaattatctacaatacccttataatatttttatttatataatttttaatgtttgtactgtttcaataaaaaattt

SEQ ID NO: 369 - DNA, 639 bp, Leptinotarsa decemlineata
  Annotation=Probable 39S ribosomal protein L49, mitochondrial (Fragment); Tribolium gene name from OrthoDB database=TC007075; Blast E-value Tribolium Gene vs. Leptinotarsa Unigene=2E-6; Blast E-value Tribolium Gene vs. Leptinotarsa Unigene=0
aaactttactgcatttacataatctccattcattcttatgaatccagcaaattcattaacatgacttcgaactggtttaaaggtatctttatggaggaattttaaaaggtcattttctaattgaaatatattgccttgaatatttttgataattgtatgctttcttattcctctctgtcccagtttcaaataaacaggaatcatgtggtttctcgttctttcaacaaagtatggtttacttttcatttcttctccctgtggtttccagcctgaaggatatacttctttcttcaacggttctggtactatatgcactggcaaagctctttgcacatattgccagtcatgcggatccttagtaacttcatattttgtgttcacttcaacgtcttccaggaaaggtgatgatttatagctagaccatctcacaaactgcagagtcttgttttggacagataagcaagcagacaataatcggcgacttgccgaagttatacctgccattattttattgagaattcttcaaactgcttgctgaagaattatttaaatcctttataaaaagaaataacccaacgtaagtaatcccatttgcgtattatttataagtttggaggttatatcatccaccgtagcaat

SEQ ID NO: 370 - DNA, 2428 bp, Leptinotarsa decemlineata
  Annotation=Oligosaccharyl transferase; Tribolium gene name from OrthoDB database=TC010433; Blast E-value Tribolium Gene vs. Leptinotarsa Unigene=0
ttttttttttttttttttgtaaggccaaactttattaatatacatataaaaaaaatacaaaatcatcaagctgacttattaaacacccctgttcggaaggtctttcactttgtatattctaaccaaccaatgctctgtggtataagcttcctcaagaacatccaactcaaaatctttattaccaatttctgctcctctcactctatcatagccaggaggtttaccaccttcagtatagacttgtccaaatctatagtaacacattttgtacattagacagtttaacaatgtttgagaaccttccttgtccactctgaactctccactgggtgaataataatcccattctttgatatgtgctcctctatcagtacttccacctattctaaccatccataaaaatttatttatatcatctgatgaatatccagtaagtccaccaaaaataaccaacacataatcaacatcaagttctttcattatttcgtaagctttttcttcagtactggccatcgcctgacccactctactgatatgcgtattattccaagtattgttatctaccagaatggttcgattagccattgctgttatctgatagccataatcccaccaagacatgatgcgggcatcttcaggagtgttcatcttcaaccaataataagcttctctgaaatcatcaaaaattattcttcctccatcatgggacctggcactaagaacgatactaggtgaactgtaagcttcagaagtaacccatgtgcagtggaatgtataggatatcaaaagaatggttactactgtcacaaacaatgtagaaatttcatttttcagtgtagtgtttgcttccattttcttgtgatgttttttatgttcaacttgtttgggaagatcggtattcttcatgaatttggtgagtagatgtgatattgtaatgccactgagaatacacatcacaggagctaggactaacattagacggaccatcacacccgcaaagtatatactggtgattccatacaaaatcatgaaaatgttagcatcagttaattgcttgaagcagaagtaaagaccagcaggaaacaggaacactaaaatctgcagatcaaaataaaaggaactccacgaagtaggttgatgctctgatacactggcaatgattggaatatgattttttgcgtaagatggatccagaagagaataaaatcttcctgtccatggagaaattttgccggagaatgttaagatacctcccactgttacaactaatattccaacagtatacatcaaaaatgtgaataatgtatcaaagtcattcttcgataacttgctgcgaacgtaatcaacgaaggccacaatttggcatagaccgaacactcccaaagccaacatatgttctgaactttgtactggctggaatccaacaaatgatatttgcatagataaaatagttcctacacaatataaggtactatatgcaacgtagatacgatggccaaaccttcccgttgccattaaggtcaaaacatgtagaggtatcaagtttatgaggaaaacataaccgccccaagaggaaaccatataaaaatatgccaaggcactaagagttccccaaaaaattgttcccgtcttaacagcttttatccaagtgtagtatgtcagaagcatacaaaatatagcaatgccttcattatcatagctcccagcaacagaacggctgatatatccaggtacaattgatacaaacgctgcagctaccaaacctgctccagcatttttcacttctttcgtgagcaaataagttatgattgttgtgaacgatgaaaataagggtgcaaggaatacacaaacattacgaatatcgattgtaatgttgagcaaccaacataagtggtaaataactgcagaggttaccattagaccagggtatatagttcctccaataattctgcccaatggataccatgctctatcatcaaaccaattgtgaaaagaataaaatccttgctctgccaagtattttgttgtacgataattaaagtaagggtcaaattcatggataacgctctcaaatctcaagactgaaaaaagtcttgtggcaaatgagagaattgcagccaaagtaagtatggacaaggtaagtaatgtttcttgtttctctgcattttgtgtttgggaaggatttctctttgttagtccaaacattcttatatatctttatttgtaattattttacaaacaattcgcaaatataagactttctaatttcttttatcaaaattttgaatccataactaatagaagcgtataccgtgtactggcttttatataaaaatgatattttaaaacattaattttaataacattataagcaaatctcatacggcatacacgtcacttaaaaaattgaagccggttaaattcttct

SEQ ID NO: 371 - DNA, 982 bp, Leptinotarsa decemlineata
  Annotation=Cysteine-rich hydrophobic protein; Tribolium gene name from OrthoDB database=TC012812; Blast E-value Tribolium Gene vs. Leptinotarsa Unigene=3E-91
taaaattaatcaacaatctcgatacaatataaaataacagacagtcaaagagaagagataatcataatccgaaaaatactataaaatattcacaactttcgatgaaagtcacttgattatattttcaaaaatacaagaaaattacctaagaaatatcaaatgttgattttttctttcccttcagtcatagatgatcctcttgaatatgtagataattgatggatactgatataacactgacttacacaaaaggtgagctcgaatctttcactcccaataatattcttgttatatcagtatctgtccagactcagagtcattgacaattaaacacttaagtttcacatgaaaaactcctgtgtggagtgagacaatgtaagtcatgcattcggaggacggtcaagacagcttatttctagtaccctgaggcctcttgtacttggatctgtcagcttcaatcccctaggttcgtatactctctcgttttgttcagctatgaatttcgagactttcttgagacacttttcgtaatgtgtttctttgcatatataaattaaataggcagtcaggcaggccaagcatccttcacaatatgtagagcatgtagccttctcagcttcagcaaaataagcatttagtctgtttattgttgtttcaaatgcttgtctttctaaccttccttccagttcttgtggaaatctagtctgaaatttcaccaatgttccttcactgtaatctctttgaataaataccttcaaacactgtggctgagtcatctgctcagtttctgcatttctaggattactatgatgattactcatctttatttgacctattttgttaaaattatttgttagatttatgtacctaccaaatatctagaaaccactcaaaatattgatcatctaaaattattcaactttattaacgaatgaacaattttttgttgttgtcaatgtcataattttcgcactcggtattc

SEQ ID NO: 372 - DNA, 458 bp, Leptinotarsa decemlineata
  Annotation=J domain-containing protein; Tribolium gene name from OrthoDB database=TC011165; Blast E-value Tribolium Gene vs. Leptinotarsa Unigene=1E-16
ccatcattcttgtctggatgaaactgaagggcccgtaccttgtactcagcatttatctgctcgatagaagaattttcatcacatcccagaatagcgtagtaatcttcatctgctttttcttataatccagaatattatcgacattcgtcattttcggaatacacttccaacttctcaccttccaacggtgaaaatcaaactaactcgactccggcgtcacttctcactctgaaaattccggggaaattggaaaacccagttcgaaaggcgcggtaaatccgagagtcagctgtcattaacaaaacacgatcggatactactggaatgaccgaggttaattttgttcgtattggtaacttgaaatatggtgaaagtttgtagaataaaatggatatatgtgaatttcaagaattgaggcaaagatatagcgtttgaatgtcaggcatgcgcggtacgac

SEQ ID NO: 373 - DNA, 1132 bp, Leptinotarsa decemlineata
  Annotation=CDP-diacylglycerol--inositol 3- phosphatidyltransferase; Tribolium gene name from OrthoDB database=TC015176; Blast E-value Tribolium Gene vs. Leptinotarsa Unigene=7E-112
gacacatgagatatcagacgggtcaccggtcagagtaataaaaaatctatacaacaaagttgttttgaggtattgaatttgtattgaagtgaaccctaaaacatttttcaataattcactaattatattgaatcagtaattcaaacgattgttctactacatttcgagatgagcgacgaaaatatattcctatttgtgccaaatatcataggatatgccagaataatattagccatcatatcattttactttatgccctcgaattacattgtcgcctgtacatgttatgtgacttctgctcttcttgatgcagttgatgggcatgctgccagatatttcaatcaaagtagtaggtttggtggtatgttggatcaacttactgatagatgtggtacaatgggcttggtggcagttttggggcatttttatccaaagtatatcttcttattcatcttgtccatgtgtattgatgttgcctgtcactggatttttcttcacacgtctatacttcaaggaaaaacaaaccacaagtttgttgacatgtctgataatccaattatgagtatttattattccaataaaatggttctgtttataatgtgttgtggaaatgaggccttttatgcttctttatacttgctctattttacagaaggacctttgattgctgggatgggccttttcaagataatattgttcctgtctgcaccaatatgtttgggaaaaaccattatatcccttattcattgtgttgttgcatcaagaaatttggctattattgatttgaatgaaagaaaagatctaaagaaaaaggcattttgaaatacatatataaaggtgctagaaaatatgtgaagaaataagcatttcaaaatatataaagaagtgctttccttggtgttaatttaatttctgtgctagtcattgccattttttatcttgtgtataaaaatgtcattccattttgtaatacgaatgtattttctaaagttgtaaattggatgttttaaaccaaaggatctgaacccccttctatttacattgtttgttaccccattgatgttaatgatttgtaaattgaaactttatagatatatcttccaagaaaatgtattaaaatagattctatagg

SEQ ID NO: 374 - DNA, 2149 bp, Leptinotarsa decemlineata
  Annotation=Zgc:136858; Tribolium gene name from OrthoDB database=TC013351; Blast E-value Tribolium Gene vs. Leptinotarsa Unigene=7E-1; Blast E-value Tribolium Gene vs. Leptinotarsa Unigene=06
aaatatagtttcctaatgatacataatgatacaaatgtattattaatttcactatttaaagaatattctgataagaggcagatctttcccatgaccgatgacttctatcaaaaatttccatcgggactgcagcttgacatttcaaagctaatttagcagcagcgaatcccactgacacacaaacctcttcagacatattcgcaatcaacgcagctatgaatccgctggcaaaacagtctcctgctccgctcacattgacaagactattgatagcttcagttggataaaatcgaacatgctcctcatcataattgtttgtaaaaaacttttcggttactagtccttttcgagctaccaaaactcctttggagccaagagttacaataacgttgtcgattccatgactcaataattttcgactcagttcttttgctttagcgatatcagaagaggatttttggggtacaaagtcaaagaatcgggcaatatgttcgagttcacttaaatttggagtaatgaattttatcgctttccagtgaggcgtcttaaatggttttgtggatggctcgacatctgttggttcgaaaagtactggtatgttgtgcttcacggccaacttcaaacactcttcaatagcttcttccgataaattggaatctagtattatcaagggagcggtcttgattatactttcgttttccagaatcacctctggcgtgattttattgtgaattttcatgtctcccattagcaacctgcagctccctctatcgtcaaacactacgatgcattctgcggtgttgcaactgtcgtcgactcgaacaaaatgccggctctgcggtggaatgacggacatgatcattttacctctttcatctgctcctacgactgacaaaaaatttggagggaatcccagcttgcacagagattcgcaaatgtttctgccaactcctcccgcagtgtaggtgaagtttgcgtttaaaatccttccatctaactttatttcagaagtatccagagttgcactgcagtccaaattagatcccccaatcacaaacggccttccttccaagttgaactgcgaagcgtcatttcctgtttgtgctccatcttctaacgctaccagtgccacagcaatatctgcagccactctggcattattctttatcagagccacattgctctcgagcgacttgccccccgtcaatttggcgatttgactcagtaaataaggagtgatatttttgcctcttacatcatcacaatttgcttccttcaaggctttttcaatgaaacttcaataatctcaggatcaaaggcatattcctcaggtataggtacagcaaacagcataccagactgcaagtccagttcgttgtgacactttatgactgcagctgcctcttctgccctttgtatacagtatggaacgttgaatccactttttgttgagtagaatgctgggaagtcatttgtttttccaaaagtagctacaaaaactccctgagtttccaaatactccaatgtttttgaaatatcaagaatagatttaacaccactagaaatgacagcgattttgcttcttcccagttcgattaaatctgctgatatatcgaatgtggattcagcgcctctatggacacctccgattcctccagtagcgaaaataggtattccagctttggtggctgcaataattgtagcggagacggtggtacctccatttctcttattactaatagcgtaagacagatcccttcttgagattttcactggatcgctggacttcgtatctcccaatgtaacaatttcttccggagacaggcctatttttattctaccctttacaatggcaatggtagcgggaactgcgccctgttgtctgactatttgttcaacttgtagggcgcaattaacgttttcgggaaagggcattccatgcgtaatgatggtggactcgagggcaactacagcttttttttgtttcagagcatccctgatttcttctttgatgtacatcgaaacttttcttttcgcgggaaaacttttatgatttttcaaaattgctaacgttttccctagacgaatcatgactgtacactcaaataaaggaactgaataagttactagtgaatgaatcagtcacaat

SEQ ID NO: 375 - DNA, 425 bp, Leptinotarsa decemlineata
  Annotation=CMC1; Tribolium gene name from OrthoDB database= TC006280; Blast E-value Tribolium Gene vs. Leptinotarsa Unigene= 2E-5; Blast E-value Tribolium Gene vs. Leptinotarsa Unigene=0
ctccaataatggaaaatacagagaaaaaacaaactgtgttctctaggtattgtaatggaccccacggattgggagatccagatgatttatttatgagaaaagtggaaatgaatgtattgataccgaagaaaatgcgtgagaaagccagagttgaaaaatgtttcaaagaggttgaagaatttacagagtgctgtaaaaacactggcctattgatggtggtaaagtgcagaaaagaaaattcatctttgaaggaatgcttagttaactggttgagtaatgatcagttcaaagaagaatgcacacaggaatatttagcagaaaggtcggaatatagaagaactggcatttctcggaacaaaacacagagaatgggttcaatgtaattgattcttaaacaattaatgaaaaatgaacagcactaggat

SEQ ID NO: 376 - DNA, 631 bp, Leptinotarsa decemlineata
  Annotation=Putative uncharacterized protein; Tribolium gene name from OrthoDB database=TC011099; Blast E-value Tribolium Gene vs. Leptinotarsa Unigene=2E-34
agattcttcaatgtggctttttggagtcgttcttgtagctgactttctgacgccaccgcctggtcgagatggaaacacaactttacctccattcgacgcaacaggtttttttgtggttgacgaaactgaagcagaaatatcagcaacgttcgatgtgttgtcttcctgggaaggtttgaatccaggtggcaaaaatgctgataaatctactggttgaactttgataccttgtaaaacatcctgctcaatcggtttcaatgtcgtactgcttgacagtttgtatcctggaggtaaaaacttggacacgtcatccgctttcgtgttctttgataaaccactttccgttgtactcttatatttgggcactctgtaacctggtggtaggaatttagatatatcatcggctttagtgtttttgaatatgctactttcagtagttttctcagtctttgatagcttgtaaccgggtggaagaaatttggatatgtcatcagatttggtattcttgagaaaactactactttctgtagttttttcatctgatttgggtaatttataaccaggtggcaaaaaatttagagatatcgtcagctttagtgatctttgataagcttccctcagtggttttttt

SEQ ID NO: 377 - DNA, 1907 bp, Leptinotarsa decemlineata
  Annotation=CG9779; Tribolium gene name from OrthoDB database= TC012251; Blast E-value Tribolium Gene vs. Leptinotarsa Unigene= 3E-81
atacgtcaagaagatgaaggcgtaactatttttattattacgtcaaattctaatccagttgtcaaataaaaataaagttttacttcagaaaataatcatcttttaaatatgggtctttttggaaaaacaccggagaggaatccaaaagatatggtgacagaatggaaccacaaactcagaaaagagggataccagttagaaagacaaattagatcgatccagagagaggaggaaaaagtcaagcgttcactcaaagaagctgcacagaaaaatgatcgagatacctgcctcatcttggcaaaagaaatcctgcgagcccgcaaagctatcaataaaatttatacttctaaggcgcatatgaactcggttatgctacagatgaaaaaccagttagcaacattgagagttgccggatctctacaaaagtcaactgaagtcatgacggcgatgcaaagactcatcagagttcctgaggtggcccaaacaatgcaggagatgtcaaaagaaatgatgaaagcgggtattattgaagaaatgctggacgaaactatggatgagatggaagatagcgaggaaatggaagaagctgcgcagtccgaaattgacaaggtgctatttgaaataacagaaggaaagattggagaagcgcccttacctcctacagaacctgcagacagagaaaagtccaaacctgctgtgggagaagcagagggagaggatgaaaatgaattagaggagatgcagagtaggttggccgccctcaagtcgtagagaaagctcgattttttttcactgctagctctgccttgaaccataatgagtattcccatttttgctgtgaagtaaaagtaactttggaacacgttttttggaatatatttttactcaaattatttttgttgagtagtttgttactaatttataatagaaaatatcaccttactgaacaattgcaaatatcgtaactgcaggcagatataactgatactatgacaagaaacgttcaattatatagcggcttcatttcatcattttaaacattaatttggagagcaattttttattcagatatatattgtgagacagctgtttcaaattttgaagaaacgttaggtaatatatttttaataagaatgttatatttattttcgattgtatttattaataaaatattcaaaatgaagtttcatttgttgttagtttatataaaaaagtagagcaaagaacagcaatgtccagcatagcatgcatttcataaaatcgctatatagcatagaattttaatgacacataattttaatgactttctatagtgatcagtaacctgtgtgaaaaaaaaatcactttttacaatgaaaattttatatacctatttattattcaaattcctttattcagcataagctaatatacaatatgtttgatcctaactatcatcaggctgatgtcaaaatattcaaaaaatgaattacaaatatatacatatatatgactggttacaatcacaaataataaacttcaactcacaaatgaaatatttgtgacaatctcgagatgatttttaattgaataaaaatcacaaacatgataaaagaagaaattttcattatcctgttcatacaaaaaattataaagcagctaagtcgagtcaggggtgttatatcagatgtaccatatattttttttcactaatctaattttgttattcatccacctaagctgttttttgcatattatttttcttttggtagtgtgcaaatcactatttttgtaaaaatcgtgtaaaatgtgaagttgtacttagtttcatagaattgtataaaacatggctgttttaatgctttaatatatttacttacaaaaggtattgtatttcaagctttcaataaaaattattcaaagcaaaa

SEQ ID NO: 378 - DNA, 624 bp, Leptinotarsa decemlineata
  Annotation=CG6144, isoform A; Tribolium gene name from OrthoDB database=TC000790; Blast E-value Tribolium Gene vs. Leptinotarsa Unigene=3E-97
agtaaacaaagatgcattatgatgactttaccggattgaattttcatttttcaaatggatttaactcagtttgaagtaaagggggttcctccaacagtttattatatccccaacttcattacgaacgatgaagaagcattcttgttgaaaaatatttattcagttccgaaacctaaatggacctgtttatccaatagaagacttcaagattatggtggtatacctcacgaaaaaggaatgattccagaaaaaattcctacttggcttcagacgtacatgcataaagtagataaccttcacatctttaatgataagaaatcaaatcaagtactcatcaatgaatatttaccaggccaaggtatcatgccacattccgatggaccacttttctatcctacgatagccacaataacgtgtgggtcgcatactgtgttggagtttatggaaaatgatgagaaacgtgtgaatgtttgcaatatattattgaagagatgtagccttgtgataattaaagaagatatgtattttaagtatttacattccatatcagaaagagaagtagacaacattggaagctgttccaatattactcctgctgatgaactggaactgaagaggtcaacg

SEQ ID NO: 379 - DNA, 2125 bp, Leptinotarsa decemlineata
  Annotation=Beta-catenin-like protein 1; Tribolium gene name from OrthoDB database=TC005070; Blast E-value Tribolium Gene vs. Leptinotarsa Unigene=0
aaaaatattttattccttaaaaaattatctctcctaaaaatatacctcattcaatttaaactaagttatattactacaaattaaatataaatatttaaaaaattaacttatatacaacacaaagttgcatacactggcaatcctctcccatcctctccaatccaatcctcgttactttgtattcacaacagcttcactatattcaatagagttcagacaaaataaatataattgttcaaagattgacaaaatttcacaagaaagtatcatttcaaaactttcacagcttccaacaaaaatcctaactaaaatttatcgaccaaattcaatatatgctgttgctcctgatccctccaatctttatctccttcttcgcccaagtttcctgcgtattctctcataatatgcttgatggttttcaaagaggctcccctcaagttcaaaatgtgcatgacccgttgtttgatgctagcagggcctgcagcgcatacctctactattatataatcaaccaactgcaatatgaataggcccccttccaaccttttcaaatatgacgcttcctcatcatcagcattatcctccatttgatcctcaaccaattcgaccttttccagatatttgaaatgcagctccaaaagtctgtcgactttttcgtgatcattctcagtgaatttgctgacaagcctttgtctttgagaccctctacagtttctgagcatagacgctattatagaacagacgtgctcctcatgtgcctctgtcgacagcacttttctcctgtttttctttggtgtcttcataaaaagtggaaatattgttcgaagacctaatatgtcaacaaacttattgcagttatccttgccatgtggcccagacatggcgtaatctaagactttcagtgagccgttacgagacgttttcttctctctcaacatgaggttcattagttgtaacccctcgcctttaagaaagtggtctctattctgaactaccatcaaagcactgcagaggcaattgaacaaattttccatcaactcgtgctcttctgggctgctcggatcgtgtcgcttgtagaaagcaagttgctgtagcaaagtgtcgattccatctatatttcccaatgcaatttgatttttttcgttgtcttgcagcaagatagataagatctcgctgacatagagtttgtttgcatcgaaaggcgctttgactttgagccttttgagcaaccatgtcaataggccttgttttgcagcttcgtttgtaatgtcgctgctcaattcagttaaattttctataattgagagagtgttgtggacgccatctgcctcttctttaacagattcatctagtcggtctagattttgtaccaacaaggctattacttggtgttctagtaatgcctcaataagagtgtcagcaccttcctctgattcattgagaatatcaacgtcagtcaactcctgcaacaattcaactgtggcgaccgatatatctgtattatcatgtgccaagagttccaaaaggcttggtatcacctgtaatttaacaagaagagggtagtagtcaggagctgtggccaaaaccctcatttcttgcagagtttcatgtaactccacttcgctatccatgaacttttccggagaatcaggaaacttgattcgcatctccctgttcttcaaactccgtttttcaaaattcaaaacaatcttttttaatgtggtttcatcaattacttctccctgagtctgttcggtttctacaaactttagaatttcagctctctcttcctcagttatattttcaagaggttgaactgacggagttggggacactggccttgccattttactggctttggctctggcgattcttcgcatttttcgggctctttccagatcatcgccctcatcttcaacttcgacgggtcttttgagggcttgaggtggcttataatctaagagttcgccaatatccattcttaatttaaatttcctatctacaaaatctacgattcaaattcttctctatgaagctgaaaagtgaggttacatatatatatttctctctaggagtctaggatgatggcttttgctaccgtacatatatatattttcaaatggtc

SEQ ID NO: 380 - DNA, 1502 bp, Leptinotarsa decemlineata
  Annotation=Probable asparaginyl-tRNA synthetase, mitochondrial; Tribolium gene name from OrthoDB database=TC007211; Blast E- value Tribolium Gene vs. Leptinotarsa Unigene=0
acagaataatttctgtgaactaacctcttctcataaagtaaacaaatatgtactcctgtagtttgaaacgattcccttcttttaactcctctcgaaaacgaaattattgtcgagaagttccagaaagtattttaaatgtcttgaaaaattcagccgttggtgatgaagttaatataaagggatgggttaaatcgttgaggaaacaaaaggaaaatgtcttcgtagacctcaacgatgggtcaactggacaaaagttacaagttattatacctcaaaatttatttcccaaaaatgtaagtccaggtgcttctataagtgctagtggcttattgaaatcatcaccgaagggacaaattgaattaaatgccaatgaaatcaaaatatatggagaatgtgtaattgcggatggttatccgttttctccgaagaagtggtatgcaccagaatatataagacagtatctccatttgagaccaaggatcaacagatttgcatccttgatgagaacaaggagcaccgcaacttttgttatacatgagtatttacaatctgaaggatacataaatgtccacactcctattttaacctctaatgactgtgaaggtgcaggagaaattttcagagtaattccagaaagtaaagatctacttaaatcaatggtcaaggaaggagaatcaattgatgaagcctttttcgatacaaagacatttttgactgtgtcaggacaattacatcttgaagcagctgctcatggtttaaacaaagtgtacagttttggccccaccttcagagcagaaaactctaggagtagacttcacctagcagagttttatatgcttgaagccgaagttgcttttctagaagatatgcaaaaattattatctgtcatcgaaaatttgttgaaaaatgtgactaaattaatgttggatagatgtgaaaatgatataaattcttgtcaagaagaaaagcctgatttcaattggctgaacaaaaattttcctatattgacttatgacgagtctgtgaatattttgaaggataaccaaccagtattttcagagggatataagccagaagaaggtatttcaaaagagcatgaattatttttagtgaaacattgtggaaatgttccagtattcattataaattggcctaaaaacatcaaacccttttacatgagagaatgccaggatgatagaaccaaggtacaagcagtagacctattggttccaggaattggtgaaatagttggtggaagtttgcgtgaaactgactgtgaaaaaatcagagattctttaacccacaacaattctcagttggattggtattttgatttaagaaaatatggaggagttcctacaggtggctacggtctaggatttgaaagatatttgttatttattactggactgaaaaatataaaagatgtaatcccatttcctaggtggcctcacaattgtaatatgtaaataaaaatatgatttagtgtcaatgatctaagc

SEQ ID NO: 381 - DNA, 888 bp, Leptinotarsa decemlineata
  Annotation=Uncharacterized FAM18-like protein CG5021; Tribolium gene name from OrthoDB database=TC003329; Blast E-value Tribolium Gene vs. Leptinotarsa Unigene=7E-114
acatatatttaaaattatcagaacttataattcctactacatatacacatcatataaataagagtagtttcttgaccctattgttttaaacagtattggttggctggctcaaaggatttgcttgtgaagtttgattttgacgagtaacaatggaaacagcattctggataacttgttttcgaaaaaaatctgaagttatagtacctatgctctctttattacccactttacacttgatgtatccataaagatttgatccgttcaaaaccagtgcaatggtgaccagtagcatccatctgggtttcaacccaagtaaagcaactataaagaacacactccataataaaggtgttaaaactagagcggtccagaatattcgagcctctctttcattcactcgattctttcgagattcaaaaacccagtgtgattttccttcatcatccacgtaattccaccatctcaggccaaccattaaccttccagtaatattctttactgtccaaaaatccattgaaagtaacaaaatcacaatgatgaaacttgttatgaaactattgctaaaccacccacaaaacatgtatgccacaacagcagctcctctgaatactaagtgaaaaaaggtcacataaggatgcactaatgaatttttatttctcgtttcatcctcttcaccaaaagcaatcgtatcatcatctagaagaggcattgttgcagatgacatctcaaggattttctaatctcaagcaattctaagtcggaaataattattctcactaaactcctccaattcctaaatatcccaattcactttaccatctttcctatgtctactaatgataaatagataaattatctttgttttttttagtatgtcaaaaagtcttc

SEQ ID NO: 382 - DNA, 1896 bp, Leptinotarsa decemlineata
  Annotation=Serine/threonine-protein kinase PFTAIRE-1; Tribolium gene name from OrthoDB database=TC009740; Blast E-value Tribolium Gene vs. Leptinotarsa Unigene=6E-94
ctaacgtctagtagtttacttttttttttttttttgtttactttcttaaaatgtatattcaataataaattcttattaaactaaacagtaaaacagtaaaaaatattgcaacaatagtgcataacgagtttttcaatgttttaaggaaaaactaagagactatggactatggtcattgttaaagttttttcctgagagaggtggtcaccggcttcactttattgacgagtactgttctggatatagctgcacgccttccaccgtgaatatggaacagtcgtctggcagttctagtaactttttaggtaacccatcaaaatagcggtgtaacattgcttcagcagcgcctagccttttcaaaggatccaactgaagaagagaactagctatagcttctccattgacaagatcatgaagccttggccaatacaaacccaatcttttcgccttatactgacccattctgtgcagcttatatcctggcagttgcgtaacaccagaccaatcttcttctgtaggcgtacccaaaaccttgaatattttatctaactgatcataagtatcccgaacaccaggaaaaattgccattcctgtgatcatttccacgaatatgcatcccactccccacatgtctaatgaagtggaatattctgtgcttcccagcaatacgtcaggtggtctgtaccacaaagttactacttcatgagagtaagtatgactaggcactgatttggctctggccaatccgaaatcagccagtttcaattctccaatttcactaataagaagattttgaggtttaacatctcgatgaagtactcttcgcttatgacagtaagccagaccacgaagtaattggaagagaaatagacgaacattccgggggtcgagtccaccgctgtgacgttctaaatattgggataaatccgtgtggacatattcaaagacaaaagtaagtgtctccctggtgtgtacaatgtcatgtaaggtgacaatatttgcatgtttcagttctttcaacaaggaagcctcacgaattgctgtgaacggagcaccttcttcttcctgcagtctaatctccttcaatgccaccacctggttttgtaaattgctaaatcctttatacacggttgcatatgaaccttcacctaattgttctagttttatataagcatccgacttgccaaatggtgaatcacccccaaaggctgaatacctcttagtccgtcggtgatcacttccttgattgagcaaaacttcggatttgggcctgggaggtttccttggcctcagtattactttggtttcttctcgaatgtcttcatctaaaagtttgctatcactagaaacagatagttgcctttttaccctgtcgtgaccaggaacgctgttccactcagctgactgtgcactccgcatcgtacccatgttttcactccttccataagttgaataatccccatatccaagatcgcctttttctgccggtatatttccattaggttctaatcggtctaggaactcgtcgctgtagccattatagtgcagttttccatgctgggtatgttcttccgcctcttctttcgataccgataatcgtccaaaggagtgtgacagcctcttcctgagcttctgcattcgagatagggcaccacttttttttttcgcgcattgtgactcccgttggtaagccatccttcatagttttagtttgcgtgctggaagttgcactacagtgacttttatcaactgtacaatacataataacaccttttcactaaattagaagtcactctcaccgaactaatatgttcataattattatctacagttttctaatccatcaatctatttcatataaacatacacaacagcaaaacacaaaagattactgtc

SEQ ID NO: 383 - DNA, 2396 bp, Leptinotarsa decemlineata
  Annotation=Serine/threonine-protein kinase PLK4; Tribolium gene name from OrthoDB database=TC001032; Blast E-value Tribolium Gene vs. Leptinotarsa Unigene=0
attattacccggggaataacttcattgtccatgtagttgaccacacgaccttctggatactgatagcgaatatgatgtttaccatcaacccaaagttgagacccgtctgggtatcgaacctgcacttcaccatttgccagttgaaatgctgtgcctattcctggtacagtaacgcgtttttcttttgtgttggaagtgttaccaaaacaggatccaggatttgttgcatcaatagaaattgtgaaagaaggaatcacagtttgcggttggttttcttttcctaaaattcctctgtaagaagctggccggcgtccaagaataacaggaaatgatgttcgaggtaggcttgacagagttttttcaagcagcatgcaatagtcaagagaatcttgggtatggctccacattagctcaagttccccagtaagcgttgtacattcagatggtgaacgaaaaatgtacttgtttccagatgaatctattatcgtgatgccctcggctatagactgagtaacttttccaccctcataaaagcaggcttcaaaatcagtaaggttctccataagaaagcatttcgccttctcagtgtagtatgtgattttgggagtttttgctctaaccaaatccacaaacttgtgtgcatacatatattttttccaatgtttctcaggtagattctctaatccgtaaatcttatctgccccctgaactggcgacggtggaggttcttctgcgagtggaacacccttaccaccttcgggttcatacaaaattatgcgtaaaccatcgggagatattctcataacctcacaaaccatgtcttttttgtgataaccttttttcttgatgaactctatgcaaacttctccgtctttgagaatactgagtatggcgttttttgtttgatgtcgagtaggaagaagtcgttttgaacatatttgtaacagtttttttcttgatctctcataattacaggggctagggtcccgagatctttggaagttttcctgtggtttgcagtggtattctcctgatgaatgtgaattaggagtttgactgtagagacattttcctgtggtctcactacaagaagggtcagaatggtgagagtgaagagactgtcggtacatcatacgattcgagaaacctcctcctggatctgctgggggattacatttttggctacactgactcaatccagctagactatcatgacaacaaggtattctcgatccttcgcaatgagacccacaatttgaaaaaacggaaacatggtccgattgtcttgaatttatcattggattttgatgggataagttttcacaactacgtattttcaactgttccataccagaacatataggagtattaccatagtgattttgcaagggcaagcagtcactgtttgtttttctctgatgagggtctgaataagcattatgtgaataaggcaaagatgtgatttcaccatatgtactgtctcttttgctagacattgtgtggatcccgctatcatgggtatgatgagaagataagatccttcctcttttaataaaggggtgttccaaaatttgatctaatgtaattctgtccttggatttttctggagcaaagagtcaatgaggtctttagcttccggtgacaaatgactaggtaaattataattcgacatcacaacttttgttaatgtacttttaacaccaggggtatcaaaaggtggtgatccaactaaaagagtatataatagacagccaattccccaaacatcagcttcgaggccatgtgaccccctagaggcaacttcaggagagatgaagtttggtgtcccgcacattgtcatatgtttttcatcaggtcttgttaactgggtggctagcccgaaatcggcgattttcacttgcatatcttttgtaagcagtaaatttgataatgacagatctcgatggaggatattataagaatgaagatacttaattccttctacaacttgtctcataatgccactaacttcaatctccgagaaacacctttccttgaaatatttttgcaatttgtaaatttgaaaagttgtttatagttgccatcaaagttaaacataactatttatggaaaatgggaaaaatcctataattttccgggctatagaaactaaatttattagtaaaaactgcttcaattcattgatgcagtgaattttatttaagaaatgacgtctcttggaaaaagtattgaggagtatgaagtgcataatttattaggaaaaggtggatttgcctctgtttatcgggcaagatgtttgaataccggaactgaagtagctataaaaatgattgataaaaagctcatgcaggctacaggaatggtaagtcgtgtgaagcaggaggtttccatacatt

SEQ ID NO: 384 - DNA, 1561 bp, Leptinotarsa decemlineata
  Annotation=Transforming growth factor beta regulator 1; Tribolium gene name from OrthoDB database=TC007152; Blast E- value Tribolium Gene vs. Leptinotarsa Unigene=2E-67
cttttattcaatacatgaattacaacaaaattatatttttttgtcagaacataaatcctatttgcagggattattatgaactcttcacagatttttgtcatttgatcaatatatgatgcaccattctatatttttagattgtgataaatagaagtaatgttacagggaacctataggcatgacaccaaaggcgaatttttgttaatagatagaattgttataactgaaatcatgacttgattctaatacacttgtgcacaccaacattccatttctttaaatcttattcagtacagtacgatatcatctttcgaatcaacaatatcatcaggtttctgtaaaatgtcaggcgccattttatatttacaaaaattaatactgcgttgcaggtactcgtaactgagacctgcatcattgtcttctgaatgcatttcatggtttttggaaacctcgaattttatccatttataattggtacatttcctagaacccggggaactttgtatgagatgtaatacagtgggatgagtcagtccaaaaaattcatttcctctgggtctcgtactgacaacgttgagggacagagaatcattgataccctgtagtagtaaagaatgacaaacatctggtgtatctccaatgattggtgtagaattatcatcagaagcaatttcaaacctgggaatgtcatctgcatcggagattgtacaagtatagatacatttctgggtagggtcctttaaactaccgtaaatccgagtcgatacatatcctacaggataaataacatgctcagagtgaaattccactctatcagatacaacttcaccaagagaatgaattttcaaccgtcctaattcaatgggaaatatcggtttccccgttagatctatgggtactggacgcacaaacttcttcctatttttcgaggaactttttctcgatttcagaactgatgttttcctttcattggattctaaatatttctttctactcttcctgttatcactgttactactgatagctgttggtgtactgttagtgtgacgcggtccatctttggcagaattttgaacttctagtccaacttggggttcatattcacataattttcttaacaaatatttcctttcttcttttctcactattatatttatctgtacctcttccagttcatccactagggcagcattttcatgcacatattctctgatcatttgctttaacaatgccaatttttgtttatacttccccgctagcctttccgaattaggtcttggatgattatagctaaatgccatacttcaacttatttagaaatgaataggcactaggatgatctatatccacattgaaattatccaaaagaaaaaaaccaacctaatatagaagtaagaaaaatgtttatcccggtctgttttaggtattcatgtttatttactttccactattattctactttactatcttgctgagaaatcagatagtgtatttccaattgaaacaaaattcaataacataacataaccaaagattatgacatataatataatggaaaacc

SEQ ID NO: 385 - DNA, 3931 bp, Leptinotarsa decemlineata
  Annotation=Yippee-like 1; Tribolium gene name from OrthoDB database=TC006713; Blast E-value Tribolium Gene vs. Leptinotarsa Unigene=1E-27
cagctagacactatctaactataaatttaaagaatacaaaacaatatttccatgaatatgatacatattggaaggcaaggttatcctctatcctgacttgctcttgagaaccattatgaaattgggaaagtatatttattcttctgacgaccattgctccattagtttcctagattaattcaagaaaaaaatagtatctagcaatgagaaaatcaataacttttacactgtcatagtggtttatatgaacaattgcacggaaagttgaatgaaattgcagaatatgtaatatttttgaaaaattaccacgtcaatgtgccaaagttgccttttgaaatggatttttttttcaagttcacatacagaccatatcacatactatcactgataagttaactgttttaaaattaaatctgcaactaacctgaatttttattattattattccagtatagacttcaacttaatatttctcacacaaaaattttacaataaattcgatttgaatttcctctataaattcctaaatccactctctcagatatttctcttactcatagccacagtaaatataccgagctttaacaataatgtcatttacaactatctcaaaaacattccttaaataaatgctttatatttccttgaagaatactcctatcctgaaaattcgctaattctagaatatttgtaattgtactgcaaatttataaagatgaaaatgatgccctagaattctgtaacttttttgtttgaggcaacatcatagtttcgtaagtcagcagaaaatgtgcataaaagtaaaaatcaaactgtaaaatgttcctcaaaaagttactgaataatgtagacatctgaagaaatagttcaattatagtataaaaattgggtaagattttcgattgggaacaagtattttttctatgtcccttctctttatattagtcattagtgtcatctgcatgaatgatgtttctattgtatattattgagtactatttgttgttcattttatcgtccatatcaattatgattttgtttgcagcacaagtatattttctgagttggctactctgtgtattcatcataactgtcatttgtcacatatagttgaggtttatatggtccattttcaacttttatttgctgtttccattgttcaattttccattaataattctcgatttttagtgaacaataacatgaaaactgacactaaataacgaaccatcagagtagccaatacagaaaagctacatgtactccaaatgaaatcctcatccaatgtattttcaaagtatgtcattcagaagtttttattaagcaataaccttaacagtaacattttcagtttgcctttcatcatttatacctagaattggttctgatttggatcagaaatatattagtctgattgtctctgacagatcaaatatcaagtcaaccagaattccgaatgttaaaaatacgagtcaaaaaaatgaaataaaatgagtcacaaaacattcataacaacaagatattattacctgaatattgcaggttgaattcaaatataatagtcaaggcagtaattggaaatatcttgtctcaaatttcattttggcaataaattttgatatttatgtagtttatcaatatttgattttttttaactatttgatgataataataaagtgaatagaagatgtttgctttgtcctccagctgattatttgcatttcataaccgaggcctgttactacattacaaataattttatagttctgaagcatttttaggatagaagaagaccttgcaaatgctaattatgacactaaacatctactggcagtatgaatgaaaaacatgttgtttatcgcgtgatcttaattactaagttggttttcacagtcaaaagcaaacttgtcttagatataatcaaatctagtgaaacgaaatgaaaaaagaaattgcatattattctgattgagtcgagtcaacaactaattttgtctcaggaaccatatgcttatggtgtacaaaaataggatttgagaaatatttttagagtaatcactctacataattctaatcaatgttgagtacgaattcacttataatatgcaattttaattgagaaaatcatatcacaaaagaactatcacaaatcatacaattaccaaaaataaccattcaataagttgaacaagaaacaccaatacttaatatcttgaatattgtgttacaaaaatgttttatcatattttgctagacataatgatagttaaataggtcaatatatcactgacataaatataaaaatacatgttgattgatatatggttataagtatgaagttactgtaagatgattgacaataattccgcaacatttcaaaagtgagaaaaaatatatgacttgaacaatttcttgaaaaatgaaatgaaaaccaataattccagttttatctgtcagaaagactttaacaaacatatatctttattcaatttgaaatttttcaactgaattgtccatttatttgaaaggaacatttttttttgattgctatgaccatttctttatgttgtgatatatattatattacaaaatataattgtgaaagctgacccacatgcaaaaaacattattttgttcaaaattggttttagtttcattaaacatcaattgtccatatttcaaaatgcattttgaatatgtttcacatctgcatgtgagtattatcacaattcaaaaaagtgtcactgtgagcattttccaaaactagtatcaagtaacagattttctattcagtctctctcacgctattacgtcaaaataaaaaaattgaaaattcacaagattacttctatttgaagttaagaatagaaatattatcgaataaaatcatgtaggtagtcacattctactaaaagttctgaaaaatctcatcataaaactgacaagacattcctaacttataatgttaaataaaattttctacaagaaatattatactcctcctcctagtgaaaaggggtctgaatagatgaaaagttagacacatacaaaggttcggtgagatcgtttctaggagaaagatactagaacagtattaaaaaattatccataagcctgcttacttttactatttctactattgcatgataaaacctaaaattaaaaaatgactcttaacttgaaaaccagtgttacaaataatgtaaataaatatgtgattaaacacaccatcagtccctttttaactaacacagcaataacgctttgccatggtctaataagtctctaatttgacaagtactccttaaagcaccagcgtatccaatttgtaaacgctttgattccagggttatttaacacagacatagtttatcgtttctaacacagaatgctttgtgaagagcttcaatttttaaggtagtatgtaagacgattgcacattgttccctaatgtgtattagagggtgaagaaaaggtgccttactatcaagctttaacaacgatcaatagaaattcacaacatccaatgcttctcgccacttttcaggactctaatgaaaatttgtgttatgtcacaagatggtttcgtttcgggcataactacggtcctttcacgtaactgtttaggtccagtccaaaaaacagaaattattattgaacatgagtctatgacatgtatttttacttttgaatgcctttgtgaacattgtgaatcagcttcggttgcacactattcaataaggtcaatcccaaccattttccttgatcatatgggctagctctataatgaatttgccttccttgtatttctgacttgactcgaaggcatgttcatatttccatccaagggtggtttacagcattcacaataaatgtccgcaacagcgtgtaggccagtaaggaggactctttcttcagcaggtccacatcc

SEQ ID NO: 386 - DNA, 1632 bp, Leptinotarsa decemlineata
  Annotation=Glucose inhibited division protein a; Tribolium gene name from OrthoDB database=TC012014; Blast E-value Tribolium Gene vs. Leptinotarsa Unigene=0
gctccaaacctagatgtgcttgaagctcctgtggaagacttgattgtggagaatccaagaattaattctaacaatcagacttgcatagaatgcaaaggagtcatcttaagagacggaacaagaatatcagccaaaagtgttgtcataacaacaggaacgtttttgaaaggtagcataaaccttggcctggaagtttttccagcaggcagaataggggatgaaccttccatagggttagcgaatactctagaaaagctgaatttgagaatggggagactgaaaactggcactccacccaggttgagaaaagacacaatcaattttgacgtttgccttgctgcgggaggagacaagatgcctcgtccattttctttcatgaataataaagtttggataaatccagaagatcaactggattgccatttaactaaaactaccctggccatcgaaaaaattgtgaaagacaacctacatttggaccgtcacgtcattgaagaagtcacagggccgagatactgccccagcatagaatcgaaagtcctcaggtttcccggaagagagcaccaagtgtggcttgaacctgaaggcttcgatagcgacattatttacccaaacggactgtcttgtacacttcccgaggagtaccagtggcaactcatacgcagcattccaggccttgaaaaagcagaactggtgaggccggggtatggggtggagtatgatttcgtggatccgagggaactgcagcctagtttggaggtgaaacgagtcgagggtttatttttggctgggcaaataaatggtacgactggatacgaagaggctgctgcacaaggaattcttgcaggaatcaatgcaggtgcaaaagctctcgaaagatctttcttaacagtaagcagaacggagggctacataggcgtcatggtcgacgatttgaccactttgggtaccacagaaccataccgcatgttcaccagcagggctgagtttcgtttaaccctcagaccagacaatgctgaccagagattgaccccgaaaggttttgccgtgggatgtgtgtcacaggaaaggttcgacaagactctcgaagttgaaaggctgctacaagatggagtagagttgctgaaaagtgtctcgaaaaccacacaacagtggagacatttgctgggattgcccgaatctagaagtttacataaaagaagtgcttttgatatggtagacaatcaaggcatcacgataaccaggctggctgaagctgctcccgaactgctttcgctcactcacgatccttccttggagaacagactgcacatcgaggctttgtatcatgccgcggctgccgaacaactggaagaagtccaggaagtcaggagagacgaaggcctcaccattcccgaagatttggactacaattcgaattcgctcaatctcagcttcgaagagagggagaagctcctggcagttcagcctcagacgatcgcagcagcgagtaggataccaggcgtgacgccttcttccgttttcaggcttctcaggttcgtgaagcagaggagggaaatactggcggcagtgtgaagagaaggcagttcttgtgatattatttttcctagtgagatctgttgatataatgac

SEQ ID NO: 387 - DNA, 1634 bp, Leptinotarsa decemlineata
  Annotation=Abhydrolase domain-containing protein 13; Tribolium gene name from OrthoDB database=TC005853; Blast E-value Tribolium Gene vs. Leptinotarsa Unigene=0
acacttgattctattatagaatattctatggttctatgttcgtctttctcactcttactattttcatgttattgtaatttatttggaaattggtaattcttttcgaaatttgtaaaataataatggttagtttcaatagaatatcattattagacccagaaagtatgacacgattataagttgaagaagaacgaggtagccaaatcaacatctttttgaaaaatgggacgttaccttctattttcaagaatatctgctacattattcagaatggttttgagagtttgggcctactctggtcttgttttggtattttgttttttagtgtattatatgtatggtggaatatttgccatattattattgtcttttgctgtcacaggtattttataccaagttcaagataatctgatatatactccagagttaccaaatcactccagagtttttgtacccataccatccacattcaatcttccacatgagagtataatgacaaagacagcggatggcacccaaattcatatgtattttatacatcaaccgaaagaaaaacaacgagttgcccctacaataatattttttcatggcaatgctggaaatatgggtcaccgattacaaaactgtgtagggttgtaccacaacctccactgcaacattcttttagttgaatatagggggtatgggctttcagaaggcagcccttcagaagaaggactgtatatggatgctagagctagcattgattatttatattctcgaaatgatataattcattcagcaatcattgtgtttggacgatctctgggtggtgctgtagctatagatttagctacaagaaaagagtatgccggtaaaatatggtgcttgattgtagagaatacgtttactagcattccacacatggcaaaagtactgttagggtggcgaattcttcagtattttcctctgtttttttataaaaataagttcgtgtcatatcagaaggtgaaagaattaagagttcctactctttttgtatcgggattggctgacacattggttccaccccagatgatgaaagaattgcatatgagctgtagtagctctaggaaaaatcttttacaaattccagctggtacccacaatgaaacctggcaaattcaagggtattatcgctctttggctgtgttcttacaaagttgtaggttagaaaataatattaaaaaagactttgatattaaagttgaaaacgaaaaaacacaaagtaatagtttatggaataatgtacaaactatataatttataaatgcatttttgtaaatagtttaaaactacgatttttaaaaatagcaatttttattcaattcctgttttattcaattcctgtttattcaattcacgtttttatacaattattgtttttaatttaattcaagatatatttttatatttagtacatcctaatttggagtggatatcctgctttttcatatcgatttacagtctagaattgaataattgcaaaaaagaacatgacatgaatttccgcttgtacttcatgtcattaactgactgagcctttgtaaactgttctttactgaacaaggtgtatcgttcaccatgaaatatgtatatttcattaaaatgcattt

SEQ ID NO: 388 - DNA, 1200 bp, Leptinotarsa decemlineata
  Annotation=Mono-ADP-ribosyltransferase sirtuin-6; Tribolium gene name from OrthoDB database=TC001003; Blast E-value Tribolium Gene vs. Leptinotarsa Unigene=5E-172
tgtcattcaacgaaaatatcatcctgatcttcaaattttttttgtatgttgatatcttcagacacaatattttcttttttttaccaatttttctttcttgatcttctcttcctttatccactttttactcttaggcatttttttcttaatatttaataaactctcctctgctttccgtttcttataatctttgataagtttatcatattgcaatttgattttttccacatcctgtttcagaatattccactccactacagaatcagaatcacgattttttgttggatcgatttcagaagaatactcaggaatttcaagacctagtcttttcataattttcacaatcacatcgtccacataggtatttatgattaaatcagcctttttatcatgtttggtagattgtaaattcacaataacaactttccctccatattttttgttcctcaacggtaagtttccactaggaactatttgaagggtggttcctaaacaaatattgagatctgctacactagaatgataatctgacatctcaagatcatattctggaagactgtcttcccaatctagaatcgtatcatgcagtttaccacggcaagtccgcccacgaagcattgcagaccttttacagtcttcattcagacattttttgcccacagttgaggtagcttcggttcgaacaaattggctttcacaaacgttacattgggcagtgaacatatttccatgcaattcagccaaagaagatctaggaatacctgttctcaaatgcaatccatcgatattctgactgataatataatgcagataactctcttctgttaaacgttttagggccatgtgtgtctttgttgggatggcgtcattgaaagaaatgtttatgttgggttttttaccttctttttccaaagtccataccccattaggtccccgaaagtctggtattccggcggaagtacttatgcctgcccctgtatgcactactacatgtttagaatttttcaaccactccactaaaatttcacatttttcttcaactttttgctctgtatcaaatttttctggtgtgcccaatactcctttgttttcataatgagataatccatctgcatagctgcaagacattgtaaattctaggatatttaaaacatttataatgaaattaataaagctaaaacaaattattgaaaacaaaca

SEQ ID NO: 389 - DNA, 2727 bp, Leptinotarsa decemlineata
  Annotation=Kinesin-like protein KLP68D; Tribolium gene name from OrthoDB database=TC004397; Blast E-value Tribolium Gene vs. Leptinotarsa Unigene=0
ttctctttattttttgttcacattctgttaaaaaaatgtaaaattttctagcatgacacaaaattcacattacttatccttaataatacaaagtggactagcttcaaggactcaataatcacagtgaatattatctactcatatttaattttaatttgtgaattttaaaacaataatattattttgctccaaaataatgacatttgatacaccaaatgctgatcaacaaacatttcatatctacagtgcttgaaaccaacattactgaaatcatatatttttgtaaacaatatataattatataaaaataaataaatttcaacatattcaacaaatataatataaaaaataaaatttgctaaaagagccgcatttaaacgtaatatgtatatcacaaaaaaggtaaaaaggcttggcaaatatccctttgtctaagttttcataatttccttgttccattcaaaagcgctttcagcatgcctatcgtttcctataactattcatatccaccatcatccgagtagcttgtttgtattttccttcttgttctattttagatgaagaacttcttcctacagcatgtgttggcatttttattacaatacggttgttatcgatttctttttgaatgacacctcccacaatggatttgatttgtgggcaaattgaaggtggggtgtaatcttgcgtggtacgtaaaggcatatctagtttgagatcaagcacattttcacccctatacttgggcatagtttggctcatctgtatagctgcatctgaaatgggtcttctataattatgagcaaaaggtctatcagcagggtttatcctaattttttctttcctcagaacccaattatcaatgttgtcatcatactgagccaaatttatcaatcttgttctttcttccgaaggaaggaagttatcgataatcaaaaaccattttctcaagtgcatagcagcttcgtcgttggcttcctcaatttcttgcctatctttgacataaacttcatggttatccctgatttcttgtctgatagattgcaacttgctatttagcctttttaatttatctctcttgaaatctacctgctgctgcaaacttgcaaaaacttgtttcaactcgatgcacgtttcttcctccaattcaagtttttgttgcatttctacttcaagtttctttcttgctgctatctgtgctctttgttgttcaagtctcaactcgttctcgttcacactatcgacaatattttttcctccatgaaccatctgcttctccaacatcttcagcttcttcgctagttcatctacttccatcttacccatttccagcttcttctctttctcttctttatcaatttcctcttccccatcacaaatttcctcatcttcacccagactggcgctaaaatctccattacttttttccataatgagctgcttaagtcgttcaatttcctgttggagacccaagagttttccttctttgacatcctcgtttttaactggattgttcttaattgattttgctcgataggcgtatcttaaagtgatgattgtttcttcataattcatacttgcaggccccacattggcaatcataatagttttgctgtttcctccaagagaatcctgtagtagtcgtgtgagtttggaatcacggtatggaatgtgaggtgaattttcagctaaggcatagatgacgtttcctaatgaagaaagtgctttgttgattttagtggcctctttcaatctatcccctgtagctcctgtcttggactgtctttcgctaccagccagatctaccagattcaatttgcctatttttattgactttgagtgttcctctgccatttcaatgacgatttggaaaatggcatgagaccgagagctgtgctcgttcatgttggtcatgccagttgtgcgattagcgttgccaactttcatagctctcaccatgtcttttgcactttgacaagtttgtgaatgaaggttggttacaatgacgccctctccagtcatttccctcagttcatgcggtttggagtttttcagtctgagaagatctcttatttcttccatgtaaatctccaaatatctaacactgactaaaaattccacaccagttgttctgtcaatatgggcccaaatttgtgaaaaagccctaggtatgatacctggatcttcttccagtccttccatcgtatgagttttccctgttcctgtctgtccataagcaaatacacaaccgttgtaaccgtcaagtacagatgctaccaaaggcctgacagtttcatcatataagttttgttgagttgagctttcatcataaactgagtcgtaagtaaatatttttttcttttcattttcgctgcgtgcttttggattttccacctcaattactcccctgctggaatacattttcactacactggtacattttgcttcgatttccttttcgctgagtggtctacagcgtaccacaacttgaaccgattcattgttgatatttttctccatagagtatttatcattctctgaagtcatctttatttgaagaactcaaggttaaatgttttttttatatgatatgattctatatcaatacaaactacatcgggagtttctatatggttttattgattatcttggggatttgttatttaaattgtagtgccattcaagttattttttatcttttctctttggaaagttcaacatctatcc

SEQ ID NO: 390 - DNA, 2398 bp, Leptinotarsa decemlineata
  Annotation=ATPase family AAA domain-containing protein 3; Tribolium gene name from OrthoDB database=TC014695; Blast E- value Tribolium Gene vs. Leptinotarsa Unigene=0
agtgtggcacgcatgtagcggagcgataacctcaaaatttgatgataattcattcaacttccaaaggtttcacctcaagtcacttattaacacaactgcccctaaaaatagtcagatatgtcgtggatatttggatatggacgaaataaagatcaagtacccgacttgtctcagatggggttgggtaatcctacaggagccggtggttcagatgatggtggcccaaaagagcctaatttaacaaaagctgaacgaaaagctatggaagcatacagatttgactccactgcgttggagagagccgcacaggctgcgaaagaactggagaagtcaaggcatgccaaagaagctttagaactttcaaaacttcaagaaactacacgtcaaattgaacaacaggccaaaatcaaagaatatgaagcgcacatcgctcaaatgcaaattgaagcaaagagggcagaagcggaagaaaaacggaaacttttacaagaggaaacgaagcagcatcaagctagagcccaataccaggatcagctgtctagaaaacgctatgatgatcaattgggtcagcaacagaggatgaacgaagagaatctgaggagacaagaagaatctgtagcaaaacaagaagctatgcggaaagctaccatagaacatgaaatggaactgaggcacaaaaatgaaatgaagaaggtcgaagcagagctgaaagcaaaagctaagatcgatagagaaaaccgagatttgacattggaacaaatacgattaaaagcagaagaaaaccgtataacagttttagagagtataaaaacagcaggaacagttttaggttcaggagctcaagccttactcaccgactggaacaaagttctcacggcagctggaggtttaactctattagctttgggagtatattctgccaaaggggcaacaagcgttacagctagatacattgaatcaagattaggtaaaccttctctggtaagagaaacgtctagattttctctcttggaatctgttaagcatcccattgaaactctgaaaaaattgaagcactcagagcaaaatgcactgtctggtatcatcttggctccaaaattggaagagaggttgagagatgtagctatagcaacaaagaatacaaaacagaataaaggaatgtataggaatatccttatgcatggaccgcctggaacagggaaaacgatgtttgcaaagaaactagctaaacattctggaatggattacgctattcttacaggaggagatattgcaccaatgggacgagatggagtaacagctgtacataaagtattcgattgggcaaacagtacaaggaaaggactcttattattcgtcgatgaagcagatgcatttttgagaaaacgctcatcagaaaacatatccgaagacttgcgagccactctcaacgcctttttgtatcgtacaggtgaacagagtcaaaagttcatgctggtattagcgtcgaatactcctgaacagtttgactgggcagtcaatgatcgtttagatgaaatggtggaatttggactacctggtttggaagaacgagagaggcttattagattatatttccaaaaattcgttctggaacctgctactgaaggaaaaaggagactcaaggttgataacttcgattatagtgctctgtgtagtaaaatggcccgaatgactgaaggcatgtctgggagagaaattgctaagttgggagtagcttggcaagctgcagcttatgcttctgaggatggagtgcttactgaaaaaatggttttggacaaggtggaagatcatgttaaacagcacagacagaaggtggaatggcaatcagaacaagagaagaaagaatcaaagagtatctaccactccgagaaggaagattcctatatacccattgtaccgaaagcaattgagggtaccgaggtccatgtgaaaagagaagaccaagatagtgaccaagccaaagaatcaacaaaaaaagatgaaagtagtccatccaggaaaccaactagaagtgaaaaaagttaggattctagcggtttgtagtttgttacttgctaggattgaataaacatgaggtaaactttttgatcctgccatagtttacttcaaaccgaagcccgtaaatgaatattttaatttatctcgaaccgagagttgcatttactgttactgtttcaatcgctctcgatcatttttattgaatttacagaaactttatgaatttactttgtaatctgaccttgtgatactctgaatgcgcctcagggaaattttatcagcgttctctgcattcgaattttgatatattttgttatatgttttgaggattgtgtggaattatatccaaattaggtttttagtaataaattacaaagtt

SEQ ID NO: 391 - DNA, 1624 bp, Leptinotarsa decemlineata
  Annotation=Dolichyl-diphosphooligosaccharide--protein glycosyltransferase 67 kDa subunit, putative; Tribolium gene name from OrthoDB database=TC005188; Blast E-value Tribolium Gene vs. Leptinotarsa Unigene=0
gatctagcgagttgacgttgacaattgatgatgtgtcagtcgataatgttgaagtgagttgtgaacgtgttgaactcaaaaattaaaagtaaaaatgaagagaatatcattgtttttagtcttttgggcttttgcgaatgcttcagaaaaaattaaaagtcagcttgttaataaaaatgtcgaacgatccattgatttaacatcacaattggtgaaaatcagtaccactataaccctggagaataccggcaaagatcctatccggagctttttgatcgcagaagaaccaagaaatcttggtaatgtttcatttcgtagtgtgaaggattcttctaaaaatgatttgaagtttacaccatcagatgtagacaatcatgaggataagaaattttataatgtcattctcaaacaatcaatagaacctggacgttcagttagtgttgtaatggaagaagtgctgatgaagagtttggaaccttatcctaacagtattactcaaaaagaaaaacagttggttcgctattttggtaatcactatttctactctccatattttacaacaaaacagaaaactgatgtcactctcagctctagaggggttgagaattacacaaaactcaaaccagtttcattatccgattctacaatatcttacggaccttattccagcatacaacctttcacagatgatgaaatggttatacattatgaaagtaatgccccctttttgacagtcacaaggttggaaaggttcatcgaggtatcacactggggaaatatagcagtagaagaacatattgaaattaggcatacaggagcgaaactgaaaggtccattttcaagatatgattatcaaagagatacaagttccgtacatcacagtataaaagcttaccgtaccatcctacctgcctccgcccatagtatttactacagagacagtaatggaaatatatctacatcgtcagtgagaccaagaaaagagtggatcgaacttgaattgaggcctaggtttcctctctttggaggttggcagagttcttacattcttggatacagtgtaccaagctatcagtacttgttcaaatcggacaagggagacaatatattgaacatgagaataatagaccatgtttttgatgatatgtttgttgaagaacttgtaacttccgtggttttaccagttggtgtctccgacattagagttaaaactccatatgaagttgaacgtctacccgatgaagtcacacacaaatatctggacaatatcggccgcacagtcatcaagttgaggaagactaacctagtagagcaacacatccaagatctggagatatcctacacctggaaaccacatcttcttctgcatgaacctgttctgctatctattgcactgttcctattatttgttattgttatagtttgggttagattagatttttcattaggagtccatgaccaaagtaaaagagagtgaagtttttgtgaataagtataatttccttgtttgaaatgatttttcaataaagtttttgataactctttatacttaatcgaaaatgtaacatttaattagttattctgagtgttatccagcagaagtaaagtattatgcagtttcaat

SEQ ID NO: 392 - DNA, 1221 bp, Leptinotarsa decemlineata
  Annotation=Eukaryotic translation initiation factor 3 subunit H; Tribolium gene name from OrthoDB database=TC014327; Blast E- value Tribolium Gene vs. Leptinotarsa Unigene=0
gagataacctttttaggttcgattttgcaggagaaggaaagaagaaagaagtttaattttctaataaattatattcccaaatagtggacatttagtgcaagtgcatatacagaacggggttttgaattataaaaatggcaagtcgagcaggaaattcaagacgtgttccagaaaatgaatcagcaatcacatatgttcaagctgatggattggctgtgatgaagattgtcaaacattgtcacgaggaatcgacaacaaacatggatattgctcaaggtgctcttctagggttagttgttgatggacgtcttgaaatcaccaactgctttccatttccaaaacaatcagatgaaaccatggatgaagatgaataccaactagccatgatgcgaaggctgagaagagtaaatgtagatcattttcatgtaggatggtaccagagtgcagatgtgggcaattttttaagtcttcctctactcgaatcacaatttcattaccaaacttcaattgaagagtctgttgttgtaatttacgacacccagaaatcggcccgaggttttttgacattcaaagcttaccgtttgactcctcaagccatagagatgtacaaagaaggagaattcacacctgaagctttactcaagttgaaggttggatatgaaaatctttttactgaggttccattcttgatcaaaaattcacctctttgtaacatcatgatgtccgaattagcagaaatggtacctgaagaagaggggtcgaagtttttggatttaggaacagcatcagtattagaaggccaacttcgatgtctgatggatcgtgttgacgagctcaatcaagaagcaatcaagttcaacagatatcaacaactagtgagtagacaacaacaagacaagcacagatacttgcaaaagcgagctcaggagaatgctgcgagggctgctaaagatgagccccctctccctgaagaggatatgagcaaactcttcagacctcatcctgttcctccaggctgaaccccatgatcattgcaggacaagttaatacatatagccaggccatttcccagttttgttcgcagtctctagctaagttatatgttactcaagcactgcaaaatgctaaagaagccaacactaatccttaagatattcacttgtccacaagatttattgaacaagttttaagttgtttcaaataaattacatacactaataa

SEQ ID NO: 393 - DNA, 1456 bp, Leptinotarsa decemlineata
  Annotation=Pre-mRNA-splicing factor RBM22; Tribolium gene name from OrthoDB database=TC006411; Blast E-value Tribolium Gene vs. Leptinotarsa Unigene=0
tgtcaatcttggttatggttatatgagtaatagtttctgttttttaccagatggattaagattttccatgggttttattttctaagtttccaatattctgatctgctattgaaggaggcacactactatttcttcagtaacattttgttaataaatggctacatctaaaactaccaatacctataacaggcagaattgggaagatgctgacttccctgtactatgtcaaacatgcttgggtgataatccatacatcagaatgataaaagaaaaatatggcaaggagtgtaaaatatgttccagaccttttactgtatttcgttggtgtcctggagccaggatgcgtttcaagaaaaccgaggtctgccagacatgcagcaaattgaagaatgtttgccaaacttgtctgctggacttggagtacggtttacccatacaagtacgagatgcagccttgaagatgaaagatgatttaccaaaaagcgatgttaataaggagtactacattcaaaatatggagagagagttagccagatctgaccctgataccattagtagcaaattgagtgaaccgaatgatcttctgatgcgtttggctcgaaccgcaccttattacaagaggaataggccccatgtgtgttccttctgggtgaaaggtgaatgcagaagaggcgaagaatgtccatatcgccatgagaaacctactgatcctgatgatccactggcagatcagaacataaaagacagatactatggtatcaatgatccagttgccgacaaattgcttaagagagctgcagcaatgcctgccctacctccccctgatgataagacaattaccacactttacttaggtaatttaggtaacttgtccgaacaggatatcagagaccatttttaccagtatggagagattcgttctataagcttggtgcctaagcagcaatgtgccttcgttcagtacacaacgagggcagcagcggaggcggccgccgaaaaaactttcaacaaactcatcctcggcggtaggagactcaccatcaaatggggccgctcccaaggccgcacaggcccatcctccatcgttcatgcagagaactatgaacctgttcccggcctgccaggggctcttcccgagctcagtaataactttttcaacttggaacccggacacattccattgcccaacatgccgccacctcagtcgatcatggtgccccccatgttcgctccccctccgattccgcctttttttttcaatcccccacagctgccgcagtttgcaccgccggctagcgctagcagtgcggtggcggttgcggagccagttgtgccgaaaccgacggtgcactatccgagtcaggacccagctaggttgggagccacgcaacagattcaggagtgatgacattgaatttttttgtcttgaataatataatataatttgtaactacaa

SEQ ID NO: 394 - DNA, 1012 bp, Leptinotarsa decemlineata
  Annotation=Ras suppressor protein 1; Tribolium gene name from OrthoDB database=TC004946; Blast E-value Tribolium Gene vs. Leptinotarsa Unigene=2E-169
aaataaatattagtgagttaatagtacagcaataccagttgaatgaatcaagtcaacgtattcttgatattttttttgctttatctacacatggcgatggaacaggaggtttatttgttgaaaatctgctgtataacactcgatatgtttcgcttcgcaaatattccatgaggtgacttagccccaattgcaattgatctgctatcggcgcaacccactcgttgccttcgaatttgaaaactgacttattggaagccatatccaaattaccaatttcgggtggtaaaattgaaagtcggtttccttggacgtgtagttccctgagacgggataactcgcctatttccttcggtagttcaatgagatcattttcacggagaaccaagatttgtaaatttttcaagtttttgacatcagatggaaggtattcaaaatcgttatcacccaaatagagtgctctcaaagtttcaatcatgaaaaaatttccaggtagagactcctctttgagattattgtaggtcaaatctaacacttctaaaacgggaaatgcaccaaatcctcttggtaacttatacagtcgattgagtgagacatttaagattctcaattttggcatcgatgaaagtgaaagaggtagctcttctatgtgattatttgccaaattcaatatctctaagttcgtgagatttgcaagacccgggggaatactttttattttattgtgacttaaagtgaggcgggtgagctgtgacatgttcaataaaccaggcatctcttcaaatgaggaaatccctctatcaaataaatctaattcaggagtttgaatctccctagcctcctctaaaatcttctttgccttggacatcgtcgccttcaaacttattttcaagaatatgtaaattgtaaataccgataaacgatattttccttttcatgaatattagaaccaaatatttgttgtaactctactcttcataattaatggaacgagcagtataaaaccacaaaccac

SEQ ID NO: 395 - DNA, 1553 bp, Leptinotarsa decemlineata
  Annotation=tRNA pseudouridine synthase A; Tribolium gene name from OrthoDB database=TC004829; Blast E-value Tribolium Gene vs. Leptinotarsa Unigene=9E-177
gatcgcgttggcaacactgcgttttatgacacacttaaatgtaaagttaacctagctaatgaacgtgatatgttgttgcaatcgtaacggaacatagaattatgttcaatatgcacatattttgataaaataactacattgaataattttcacccaaccggaggtaatgcttctcaggtcacaaaatattgtcaggggcatctttacgttagcagaatcgatacccaaatcacccctcataaaagtatcatctctttttccttcccaaatgtctgacacaaaacctattaaaaaacaaaagtacgatggtcggtcaaagaaaagacaatgggaagacagaagaacagataagggcgagggactgaatatcggtcctaagaaacagaagaatgaagaaaatcaaaatgtaactcaagacacaaagcctgacaaagtgaaacgtagaaagttttgtctacttatgggatactcgggagacaactactacgggatgcaaagaaatccttatactaagacgatcgaagaagacttattcaaagctttactaaagactgaattgatcaatgaagaatgctacaatcaagtgcaaaatatgcagtttcaaagggctgctcggacagataaaggagtatcagcagctcgacaaatagtatctctaaaattaggcgaaaacattgacttggcaaaaatcaatgcagaacttccagaagtcataagagtatttgcctacagaagagtaacgaaaggcttcaacagtaaatcccaatgtgatggtcgaacatatatttatgtgactcccacagttgcatttgcaccacacgatcaggaagtatctcagaaagactatcgattgaatgatgaaacttacaacagaataaacgacctgttgaaaattttcgtaggaacaaaaaacttccacaattacacttctaaaaagaaaccaaatgatcccagtgctaacaggtatataaagtcatttgtatgcgagaaaccttttcagaaagagggtgtggagtttgcaattttgaaagtgcacggacagagttttatgttgcaccaaatcaggaaaatggttggttgtatcatagctatagttagaggcttcgcaaccgaagaggtgatccacaattctttcaaaccagaaaaaatttgtatacccagagcccctgggttgggacttatgcttgaatatgtccattatgataggtataactttcgttatggagaagatggaacacatgaaaaactgacctgggaagacgtcgaaaatgaagtaaatgaattcagagataaatatatatttcccactattattaacaaagaaatagaaggagaggaaatgctgcaatggataaaagataagttatcaaagcattcctatgacgaagatagcttaagtgacgaggaatgtgttgacaatgatggcgacaaagttgaaagtattccgaatggaaatatttgtaacaatcaagacaataaaattgaaggaattagataaaaaacgaaaaaaaaaaaaaaaaaaaaagtactactagacgttagataaccactag

SEQ ID NO: 396 - DNA, 1189 bp, Leptinotarsa decemlineata
  Annotation=Mitochondrial ribosomal protein L1; Tribolium gene name from OrthoDB database=TC011372; Blast E-value Tribolium Gene vs. Leptinotarsa Unigene=7E-81
gtaagtttttctttaactgttattttttacaacaagaaagattacagaacaacttgttcgacaactacttcttcatcctcttctatatcatcagttttttcttttgaatcttccaaatacatattatgatcgactttcaataactcttgagaggggggactccacaaaatacatcttgaaatgaagtgtcctttctttttggtttcatggtattaacgtctctaaccagggctgcaaaattctcctccaaatgcttggcgtccatagatagcggtccaagaacagcttcaatcagaccgaaatccttctcatactcgtccttgacagccgtataactgataccgtgaatgaacctatgcaccattcccactacgtccccgtccaacgtccctgctttcgggttgggaaatctgcgtttcagcaaaccacgcagtaccaccaattccggcaggatttccggatgggctacgacatacttgacgtcctgcatcgcaacttgaccgttctggatctgcttgatgagttcgacacctccggagagtgagcgccggcgtccgaggcttctttctggatttcgggggatttgctgaaggcgatgacctgccgttcttcgccgtggtcgaatttgtgagggatgccagcgattctggagaagttttccacgaaacgagtctgtttttctccttgcatatataattctatcgacacgtggaggttggcattgggtttattatacatttctgggtgatgggtttcccgatgacacttgaccgcttcttcaaatgggtacaccgtccacttgtagtattttgccacgtagacgtcatcaatggggtctctcatccaagagtcatcaaacttacgctgctgacgatttttcaaaaggctctctttttttctctggttatggggacccatccaactttttgtacctccaccttcactttggccttctttctcctttctctggtaccttttcgagctgcataatttcttttctgtaaaatataagatgaatccaatgtggacctgtataggttattctgcaatgatgtaaacactccattctgtatcgttcttattgcggaataaaacatttagtaagagcaagttaaatgcctagaaaattttaacaccatatattttttcacggtgatttttaaccccaaaaattgacaagaaaactacc

SEQ ID NO: 397 - DNA, 2692 bp, Leptinotarsa decemlineata
  Annotation=Hermansky-Pudlak syndrome 5 protein-like protein; Tribolium gene name from OrthoDB database=TC007512; Blast E- value Tribolium Gene vs. Leptinotarsa Unigene=1E-162
tcttgtagatgtgcaaaaaaatggataggtatgttttagttgaatattcaagtactttaaatgccgtgatatgcgaaacgttcaagtctatgcaacgaattaagctgatgagttttgatgtctctcttcactatataattttcggggccagtagtggaggcatttatattttcaaacgtaaaccatgcgaatttttaagacttattccgagtaaggagggtccaactattcaagtggggatatcattaaatgaaaaaaacttggcagtagctagttccagaggccttgtgataattttcgaaaacttttttgttgacgggaatataaggcctcttgtatataatgaacacgagggaaataatataactgtgatgaagtggcatggaaatgatttgtactgcggagatgatgttggaaaagtatctgttgtggcaattacttcattattgactaagaccattttccaaactccgtccactattctcatgcatctagattcaagtataactcagatagatacatataaaagctatttattaatatcaactaaaacacgtacttatttatgcaatactgaaaaagaacagttcaaacaaataggcaaaaaacttagagatggaaactttggagcttgtttttcaaatgacaaaattatacaacctcttgaatcttatcatcctgttggaggtggttataagacaataaaagaaggtgaagatttttcctcgcctttaagtgatacaaccaaaattttctgtgccagacctggttcaagactgtgggaggcaaactttgaaggatctgttcttgtaacctatcagttcaggcattctttcgaccaagaaccatctgatatagtggttattgaagattctcctaatgcaacattgcacattaataagccgaatcttgaaagacttatttcaaaaaaatttaactttggaaaaatatatccggtttttgaaaagtttattctaactcatgatgctagtggtctgtattttttgaacctgaaaaaagtaaactgcagttttggagtaatactttcacaaatattgtagatattagaataattgattcatatatttatatatggaggaagggtctacaaatgaatatagtttctttgcaatcactcgaaaatttacttattgccactttagttaacagacagtattacttgtgttcagaactttgcctatattatagtgatgacttgagtgctttgatggaaaaatccgaaaaaatccatatcttagccattttgaagacaaagcttgttgaaatagaagccagagatatgttgaatagacttcaaccaattatggatattttagaaggttgttataaaaaacaaagttctggaattaagttagaaaatggaatcgttattgaaaatcagtattcatttgaatcaagtgaaagcaacagcagcagttatttaccagagacagttttgacgttcaatggtgagcattttgatgattcacaaaagctaattaaaagcagtaaagacacaaatgaaaacggaaatataaatattggggtggacaataatattatggctctttatagacaatatgttctgaataaaactcacaaaaatgttgaattgacaggaacctgcaaaatattaacgagtttaagttttgacaatctgttatctcattttaagcaatttattgaatttgtcaaagaaaaagatgatgatgatgccaccttctggtgccaagaacagatattaaagcagatagataaagatcattctatcattgacaatattaatacgaactctctacaatatgttatcgattctcttgtggctagtaccaagagagaaaatttgatttgtctctgcaactttccactacccaaagctcataccaaaaaaatagatcactataaattagcttgtaaactctttgatcatgtagataataagaatgaatacttaagcaacattccttatttgtataagtataaattaaaggtcaacagccttcatgaggtcatgctcaacctccctgtgattacacaattcagcgacaaggaagtatttaaagaattcacgggaatgttaacctacgatgcttgggatgaaatcattaaattgtttgtaaaactaaaaaaaggttattgcttaaattgtgggaataacattgatattgatgatgcgctaacttggtcggagtttggccttctcatggtcgaatctattgggtccaaaaatgcagttagattgttgaaacattattcgcggtttatacctggaggacacttggatgcaagattttatcagagttgcatcttcacaactacatgtaatgatcaacgactggctttaaattttatggagaaagttgtgaacagtgaaaattcgatagagttcggagagatgattggaagatttattcagaaaaggtatttgggaaatgatttggaagtttgtaatggaaaaatcaacttcccaacggaaacttgtcctgtttgtgatttacctgtaaatacgtctgttctaggcgagacaaagaaatgtgataatggtcatagttaccacagcatatgttatacaacaaatagtaccatttgtaatatttgtataatgaacacctgaaattttgaaatgaaaagaacatcaacaagtattatatttttataccaaaaagttgaaataaattaaaaatgtttacaa

SEQ ID NO: 398 - DNA, 2255 bp, Leptinotarsa decemlineata
  Annotation=ATP-grasp enzyme-like protein; Tribolium gene name from OrthoDB database=TC000357; Blast E-value Tribolium Gene vs. Leptinotarsa Unigene=0
aaaggttcaaagtttttattaacaattataacaacaaatattgaccaattgcatacattgggcccggagtaattttcaaagagtaaaaacatcagtgtcatactatgaaataaaaatcttacaaatgtcactgtcagctaatgtaacatacatcattttttatgttcccataaaaatatatagtcagacgttataacaatcactgcaatataacgcaagtttgcaaagataaatacaaacacatcttgaagaaaacgagattaagactattaataaaataatttcataacatgtttgttcaacattcgcacaagactcgtctctatcaacaaagaaaagacctacatttggcaacaagtctcattgaaataaatatgatacaattccactcataaattcagtaacctacgtattgtctctatcacatcaggctcagagatctctctcccatagacgcaaatctgcactctatctcacaccagccgtcatcggtctagggaaattgttctgctgcctctgcatgaaccccaagacatttttgaaaggtaactgcatgtggtaataggcgcagtaaggtagcgggtcatgcatagcgaatatggcctccctcctgtccaagacagtaccaatcagcctggttaccttctctatggacggattgtgtacagttttcaatacgctgtccggcattttgtacactccgttcccattgaccaagggaccggaattcgaacgactgaaatgcttgcaaggcctccataccagccttggatgaacagtggtgtagcaaacgtaaggcagcgacacccccactctgctgctcaaaggtatcaacgtgccagtttccttgcacttcacgaacctgaagcttacatgtccagatatcggcctcagcagattaattttactgaaaaaatttgcgagccactggtttatctctctgttctcttcggggatcagttcggtgctgcttatcttgcaagtaacattggctatgacgttagattgtttcactgtagtgcacgtcagatagttgtcgccctccaggttctgaaccaccacccaaggcttctgctcgctgatgtcgttgggtagcttcaagtcattccttgacaggggtagcaagatctttgagcgttctcgaagacctctaggtccagcagtggtcattacatgaatacctctccttatagtaccggtgtcgtacaatctgtgaacgtcttctcttgaggtaaccacgtggtaattaggtgtggggatgttgaacttctggcagcgtttcagcacctccagcgtgtcgtccaacacccaaacttctttgattcccggacaaaagcaggagcatcccagcagttccaggtgaggcttggccacagcgtcgtagtacgccgaagtcgtggctgcaactggaatataatagacagcttgctctctgtccacgatttcgcaaagagctctcacgtacttctgttgttggtcactggtaggtcttggaaccgtgtagaacttgcttaccgcagttgaatacttcgtcagggaaaaaagtccttctacttcacacaccactactctcgctccagcggagtggaagtttctcgccaagtgaagcgcctggatggtactccccccactaatcaggacagtccttttcttgttctttcttggagagttgttggataaaatcatggataataaaatcttggttatcgtcaaaggtagctgaatcagttgtgtgaacaaccaaatccacatggagatccagagcattggcaaggcgaaaatcagttgtctccaagtttgaggcaaaatagcaagaaccatagccttcgcgattcgaaacagaaagcaagggtaccagccgatgatttttgacatgaaatcatcctcgtcttcttcttcatggctacttagtacggggctttgacttctggaatctctggcgtccgacctgattacgaagggttcctggatgacacttcccaaactagaagcacgacgtattcttctcctgagggtattgtctggcgaggtggaaatcggcgaaaagagttggagatgtcggactgtggattagagtccgctcggagaactcccagcgtggatactttcgttactcggccacggaactcgagacaaactttctggttgcacgaacggcattttgcccgaatatagttgaactaattgacggacacttgcactccacgttgttagtgatacacaaaagcttcgcaaattgaataaacccccgaaaa

SEQ ID NO: 399 - DNA, 790 bp, Leptinotarsa decemlineata
  Annotation=GPN-loop GTPase 3; Tribolium gene name from OrthoDB database=TC015199; Blast E-value Tribolium Gene vs. Leptinotarsa Unigene=3E-137
agtctacatattgccatacactagttcagcatggtgtggaaataaaaagaaatattaaagttgtgaatttggatccagcagcagaacatttccagtacaatcctttggtggatataagagaattaatacaagttcaagacacgatggaagacgaagatctccaattcggtcccaatgggggcctagtattttgcattgagtatttactagaaaactctgattggttgcgtgacaaaataggcgatcaagacgaagactacatactctttgattgtccaggtcaaatagaactttatatgcatcttacagcaatgaagaaattggcgaagcaactgcaagattgggaattcagcatctgctgtgtttatattatagatgtacaatttatgactgacccatttaaatttatatcaggagcaatgtctgccctcagtgttatggtcaacttagaattgcctcatgtgaatatcttatcaaaaatggatctcttgagtaaaagtgctaaaaagagacttgagtcatttctagaacctgactcacacatgttattacgtgattttgatctgtcaaccgatgtagggtttagtaagaaatatcaaaactttactgagacaatcggcacgatactcaacgattattctttggtacgctttattccgttcaatagaaaatctcacgaaaatataagtgatgttttaatagcaatagattatattatacaatatggggaagatctggatgtgaaaactcaagattttgtagagcaggaggaagatgattgaataaagtt

SEQ ID NO: 400 - DNA, 2669 bp, Leptinotarsa decemlineata
  Annotation=Coiled-coil domain-containing protein 12; Tribolium gene name from OrthoDB database=TC004360; Blast E-value Tribolium Gene vs. Leptinotarsa Unigene=3E-33
gatatttatttatgtttatgtgtcgggtctagttagtgcttggaatacttttattgttataaaacggtagaaaaactcaagatgtcaacggcacaatcaaatattggaaatgctgaagatgaagccttgaaacgaaaagaaaaattgatagctcttaaaagaaaacgggaaatgagatctgaaagtaattctgaaaactcaaatgcagatggtttatctttaccaaaacctcatttcaggagttacaaaccgacacatgaaacattgcaagaatttgttttggatcccactaaacctggagatgttacatcagaggtaaaagatcaactagaatccgcaaaatctgaaattgttattgatcagcttgatgttacctcattagcacctagaaaaccaaattgggatctaaaaagggacgtagccaaaaagttggagaagctggaacataagactcaaaaagctattgctgaactcatcagagagcggttgagagcatcaagtggagaaggagatttagcagctatagtcaacactgtgaacactacatctgaagttgaggagtgacttcagtggttgaaggatgttaagacattcagtgcgatagatgccaagcggcggcatctggccattacactttgtatatctctctcattgggattttgtaaaaaataggcattgccgtaaataaataaatgtgttagtattaagtccgcaatagacagatgtggttgtattgcagtctgcacatttaaatagcattgttcaagaaggtttttgggtgtttcaaaatttcgtgaattttaaaacttttcaaggcaactttaaatgtgattgaagtagacaataatcaggcctgttgttttgtagcgaggtagactattgttccggcagtacatcacaaataagtgagtgtgaatgtaagacgaccagataaaaccaggtctgtatgatgagcaatgttttagtaattttcaccgaaaaatcgaatagagtttcatcacgtttttgaccaaatgtagcaaatgtaatttcatttcattttgttttacctactaacacatcatctgcatattccgtagaatgccagcaggcgtctgagtctgatttctatataactgattaatcattagttttcacaaataacatattaaaaaacacatacagccccataaacctcattcagaagaaaaatgagcatgtcccacgcaggggtgtgtaaccaatcaccttcttggtgaacttgtctttctcagaaggtaccttttctgatattttcaaaaaggacattattctgccagtgcataaaaaagatgacgtccataactcaaacaattatagacctattgctcttttatccgtcttatcaaagatatttgaaagagcattctataaacgattactatccttggattctatcaacttctttgatgataaacaattttgttttcgacagggactattatctctttataaaaaaaattctctcaaacttagataacatagaagccacggcttgcatatcctgatttgcgttgtgcttttgatgtgattgatatacatctgctattgaagaaactagatgaacagtgataaacagtagataaacacgattgttttgttccttcttttacatgaattattaataacagtaagtccttaattgattgtagatctgaaacttgcgtttgaaactgttaatcatgaaatattaattgaaaaaaatatggcatgaaaggaagagtacttgattggatcagtgattaccttatacaacggaagcaggcaaccaaaattaatgagtttctttcaacagcaataagcgtagatcatggggtaccgcagggaagtattctagggccattgctatttttaatctacataaatgatactagcaaatgttatgaatgtaattatgaacattattttgctgatgatactccagtatcgatttgtgataaatatatagataaagctagtcaaaaaattaataaagcattcaatgatattgctacatatcaaaaaactaataaattgaagctaaatgtcaactacactgtttaagttcagataattagatttaaattgaattgaaataaaaatagaaaatgacaaaatggagcttattagtaaatttaaatatctaggatttatgttggacaagcatttatcattgtgtaaccattttaatcaaatacagaacaaaaattgaaaaaattatatttctttgcaagagtgtctcaacacttaactatgcaatcacgaataacaatgtatacttgagaacattatacaaccacatttcgaatattgtctcactcttctatacacaactgatttaaataaaatgagaacactacagaatcttcagaatcgcgcaatatggattattttgagatgtgacaggagtacccctatatctctagaatggttatctcattaataccagtctcattctgtttaaaagtaatttattaaaccattttagagaccattaaggtgataccaaattattgtgtttttttttggatttttaattattgtaggtagtacttattaacaaatattagtagatttttttattattgtgtttataagtatgtaactgttatataattgttatatattattaggatgatgtaccctatttgaataaagtatttcatttcata

SEQ ID NO: 401 - DNA, 2328 bp, Leptinotarsa decemlineata
  Annotation=MAP kinase-ERK kinase; Tribolium gene name from OrthoDB database=TC004803; Blast E-value Tribolium Gene vs. Leptinotarsa Unigene=0
gagtcacaaacaacaaccaagtcgacgcgtacgtctacggaaacacaaatatacttctgtcccttttctgggaatcaagattctctgtgtatagctgtcaaatattgatttgtcaattgtcataataacgtctattatctgtcgataggaaaacaaccactagttgtggttgtggattacataaaaataaatatttttgaataaaaagttcaactcgctgtggaaacaattattaaaactgaatactgtgatttgtagtaggaatgtgataaccatttttgtgaccacatatctaagatgtccaaaaataaattaaacctaacactacctcctggttcgattgaccagacaccaacagtaacacctacttcttttccggagaaaccaacaatatctaacacaaacaatagcattgataacttaactgctcggttagaagaacttgatatggatgatactcagcgcaaaagaatagaagtatttttgtgccagaaggaacaaattggtggagaattctcagatgatgattttgaaaaacttggcgaactaggttctggtaatggtggagttgtaactaaagtccgtcataaaagtgggcttattatggcaagaaagctcattcatctggaagtgaaaccagctataaaaaaacaaatcattcgtgaactgaaagttttgcacgaatgtaactttgctcacatagttggtttttactgtgcattttacagtgatggtgaaatcagtatttgtatggaatacatggatgctggttctctggatttgattttgaaaaaagctggactcattccagaaaatatactggggaaaattacctctgcagtattgaagggtttgagctacctgagagataaacatgctatcatgcatagagatgttaaacctagcaatatactggtgaacagtagtggagaaataaagatatgtgattttggtgtttctggccaactgattgactcgatggcaaattcttttgttggaactagaagttatatgtcgccagaaaggttacaggggacacactattcagttcaaagtgacatttggtcattggggttgtccttggtagaaatggccattggaatgtatcctattccacctccagatgctaaaacattggcttccatttttggtccaagaaatgaatgtgactctcctgaccatacaaaggggcccaggccaatggcaatattcgagctcctcgactatattgtgaatgagcctcctcccaaactaccttctggaatattcacagatgatttcaaagattttgttgataggtgtttaaggaaaaatccggatgatcgagctgatctcaaaactctgatgaaccatgcttggataaaaaaagctgaatcagaaaatgttgacatcgcaggatgggtttgtaaaactatggacatacaacctccgaacaaataaatggttcatatatggttttttatattttaatagttgaggatacttttatcgatgaatagaaatcgtaataatcaaaatgcttaaagacaactcttgtcagtgtcataatactgatatgttaggtcatacgaaaaagtcacaagacaaatacatcacaggggttcgaacataacctctcgaagaagttaaataacaaaaaaaattatcatagatttttacactatctatacttcaaatagtatattttgcaatgttggttaatagtgaattcgactggaaaattcagtattacaccagatggaaagataaagatttacaaatgatattttgactagattgaactattttgggtaaaaatgatgaaacctcgtcatcatagaaaataactataatttttgaacatatcaaaaaaataacaaaataatctgaaagttttctattgtgaacccaaattttcaaaaggtataactgtgctttcgaaagtgtcatgccctttctcaatgaaaaatatcagtgatttcagttctgagaggttctgtgatggaattgcatactggcaagaaattaatattttaaacaactgaacagttacgctagttatccatcaactatcttgaaatacctgaagtcttcattaggttataaaagtcattaaggattattaaactgtatcatatccatcctattgattatatgtatatataatcattagtttcacttatacaaatagttttgaataaaagaatggtaaaaatatcttgattaaaatgttccatttaaaaaatatttacaccttcatcattttgagaacaacctgttatatcaaatgttccaatttggtgtgggttatttgtgataaacacattcttatcaatgaataaaaaattc

SEQ ID NO: 402 - DNA, 1286 bp, Leptinotarsa decemlineata
  Annotation=GPN-loop GTPase 1; Tribolium gene name from OrthoDB database=TC015364; Blast E-value Tribolium Gene vs. Leptinotarsa Unigene=2E-133
gtcataagtcatgagtatataaactattcttaatttctagtcattaaatatgatacaaattatggctctatggactacaacactcatctgtcaagtgttttttcttcttttcatctctgcttctttcgctctttttatttgttgttcaagtgctttgttaaatgtttccccatcaaatgctcctcatcattttcagcttcaaatggagcttcttctccttctgaatctgaactactgtcatctgcacaatggcgcaagtaaatttcagacaattctctacctgcaggaacctcatgtagtgaggaagatgcttttatttcctcaacttcattttttctcagagactgtttggcttctgcttcaatttttcttttttcccattccacccggtattccctctcatattcttcagcagctttatctacaagtttgaataaatcttcaattccttttccagtagctgcactaactccacatacattcaaattttcataaaatgtatctagtgctaaagccatagatcttgtcaggttacttatgtaactttcatcagcttccaaggcttcttgaaaagattcaaaatcagtcatccaatcttttgcaaaagaatgatcaataatgtcaactttattcatcactacaataaatggcagtcttgccttaaacaaaatggagcatgcataaagcatgtttgacataaaagttacaggagaagtacttctagcagtatcaacaacatataaaatcactgttggaaagaatgatgccaaagattctgtgataatcgttcctgatattgaccatgtgaacacttcgatctgtcctggggtatcgacgatgcacaaatcatttttagattttaagagacagtcaacaacttctgggaacttatttgcatataggttgagcgatgtcacaatggcaccatttgggcccaacatataatgtttcattacttctttgtagttcactgtgtctctaatatcaatattagcagaaaaaggcagatttatgcaagcagggtccaagttaattacattggatgttttctgagatttggctaatctcgataccaaagaagtttttccactaccagccatgcctaatacaattagacatatcggttttttgatagtactttcagccattgatactattaatgaaaaaaactcagtaaatataaatatacacctttaaaataacatttaacaaagtatcaaatttaaatgataacaaccagcaatgcaaaaataaccaaagcacaggtatatgccaaaccacagacc

SEQ ID NO: 403 - DNA, 2780 bp, Leptinotarsa decemlineata
  Annotation=WD repeat-containing protein 36; Tribolium gene name from OrthoDB database=TC000478; Blast E-value Tribolium Gene vs. Leptinotarsa Unigene=0
acatagtcttcaaattctgagtaacgcatagtacaataaaacaactttgcttgcaacctttcccatgccacactctggcagctccggatgtttggcaaatagtctctcaacaccttttcttgggcaataacacttccatgggccttcaagaacacactcatataagcttcccccagttctaagtccttatttgatttgagaataaactctaaacacttcaaaaactgtaacattacttctacagaacctcctccttcgggtgaaagagattttatttcaaagtcagtcatcgatgggccgaacgtcttcagtttatcaataacggcttggaagtcatcattttgtctagagctgtcaagtaacttcccaaactccgataaatttacaaaactcaatggggttatcagtttactaccttcactggattctgccttcacatcaaactggatattattcaaagacgacactgtgggaaggaagaaaggggcagcttttggggccttaggaggttccttcggtttgttcctctttttgatgatgtcgatatcaataagattctgccatctagaagtcgaaagccccgagagagttatcagatctccgctgatttgctccggagatataaactcatcatcttcttcttcttctttgacttccccttcttctatagcctcttgccgacactcaggtaaagtaacaagtggcagttcgtcagtgggagagatagccctcagagttattttagcatagagtgtcttattggtccatagaaaaatccccaggtgacccacgtgagctgaggctagagcttcgccagtaggagacatgttgagagacacgcaagcagtgtcaaacatgaattggtcgacgagttgtccagagggtatgtcccaagttctgatggtacagtccatagatgaggtgactagccatcttgaatctgggctgaatgtcgcgtctgtcagttggcctatgtgtccgatgaattttctaacaattctccgggtgtcatggtcaatgatgttgatggaaaaatcttctaaagcaacggccagcattgaactttcttgatgggagcgaaagaaactcacaggttcttctagagtaaggattgtcaacggatctgtacctttgtttttaaacctccaaaatttgattaggctgtcactgctcccagttatcacaatctggttgagaccatcagttgctactcctctcacataaccgtcatgtgctttaggattgccatacgagtctctccatattccggattgcatgttaaacctatctacatgccctgtgctgtacccaacaaccacaaaattcccgcagtgtgtgaggcaaatgctagtagccaccacttccaaattgacatctaaattctttttctggaatcgttctggcaacaacttcaactctcccatcctcactttatcgtaggaccaagtcgttaccatagcaagacctgaatggatggcagcaatgttgtcccactccttttccctagtagtttcggaagtgaactgagttatggggggcatttttagaggatcttgcactgctctgccgcgcttcttgctaatttttctattgtaggatgcttttcccaggctcttgttgaactgctcggtttgggtgttaaatatcctcaaggtggaatcatcagcgcagctcagaatgttatgtccattagcaccatggaaacgaatagaagatggagcagcagcatgtccctctctgattctcaacaacctagcacctccatctgtcatatcaaaaatccacaattttagggtgttatcaggagacgaagtcaaaatcaagggttcatttggaaggcacaccattcctgttaccgcaccatcatgggctgacagcaactgacttgaaacttttctttcctccaaatcccaaaatacaatatgcccacaaacactacctgtagccattatagtgtgaccgtctgatctgaatgaaatagatgtcactagaccccaatcttgtgtgaattctaagattgtttcatcaaacttgagattatgacagaactatcctccctgtgctcagaccaactgccactacatcaattgctggagcctgttctagacaagtaacagctgctccccaacttttgaaaggatatatcagttttaaagtattaatattccataactgcatttctccattgtcactggcaaacagtattttgttaatgtaagtgctggggtgtagtaaagcacttatttgaaaattatcggtactaaatgtaagttctccatagacagcctcattttttatatcccatatcttcactttgctacctttatcaacagatattaaatgcgccccgaaaggtaacatgagatgcacttcctttgcatggcctctgtaagtatgttgaagttccgctcctcttcgccatgcatatattacattgtcacaggctgtataaacgtggtaggcatcagcagtcatgcaggtaatgtcaccagaatgcaaacggctaacgcttaaaagcccgaaatgagttattccgtatgtatgaaaagattttccaacacatgttatgattaaattttcttgcctgctctttatatatcttacttgtaaaggtatgtgattgctgacgtaccccagactcctactgggtataaatattttacttccaggcatatttggtcaattcacaaaattgaacataactaataaaatgaaattaactttaaaatcgaaaatcgcttactttaggttatatttacaaaattatgaggttatatatc

SEQ ID NO: 404 - DNA, 1003 bp, Leptinotarsa decemlineata
  Annotation=COP9 signalosome complex subunit; Tribolium gene name from OrthoDB database=TC030655; Blast E-value Tribolium Gene vs. Leptinotarsa Unigene=2E-91
ggagcttcagcatattcatatacctacctatggtatatggtcagagagtcagagcatagttaaataagtggtggtctgagtttatgttgtcaagtcagattattgctatcgctattgataatttcacttagaaaaaaaccctagttgtagtctctgccatatcgaaaatggttgtaaaagatctcgacaaattagcacaagacttggagagacaagaatttgaggcccccaatactattccctctccacaagtttatgggcaacttctggcaatttatttgtatcaaaatgatctatgtaatgccaagtatttgtggaaaagaataccacaggttaccaaaaatttaaatcctgaactgggacatatttgggctgtaggacagagtatgtggaaacgagactttccttcaatatacaaagctataaacgctgttacttggtcagaaacggtgactgacattatgaaactgttacaggatgttgtgaggactagagcagtcaatctaatttcccaagcttactcttccataaccctggatacattttctgcaatgactggtctacctcatgatgtttgtattccagcttgtaaagaacggggctggacattcgaaccagatacaaaaatgattcaccctatagggcttgccgttgaacatattggacaaactagcagtgaagaccaactatataaattaacagactttgtgtcattcctggagaattgaattaaaaatgcaagctgcgatttttcatctttcaacagtgggtagtgttatttgtagcactagcacctatatcttcagattcaaagtttcagtgtttgattcagtttaaataagctcatgaagaaaatcagttcattttcaataattaaccaacattgaatttgatcaggtgtctgtctgaagtcagaacttggcaccttggcacactttcagagttaaggccactcaaaaaaaaatgttcagaccttttgtcccctaataaaacttgtaagtag

SEQ ID NO: 405 - DNA, 2439 bp, Leptinotarsa decemlineata
  Annotation=Novel protein; Tribolium gene name from OrthoDB database=TC006734; Blast E-value Tribolium Gene vs. Leptinotarsa Unigene=4E-13
aggaactgaataagttattgaccaacagccatttgagaagtctcctaattactgtcgatggaagtgagaatgcagatgaaatcatgcagaaggctatgcaagaaccgatttttgtagaatttgctgatgcatgtctaaaagctgtgaatcaaaattttgataagagtacctaaaggctgcatctaatctaatatcgtagatgaggaagagttccctgctcttctctgggtttgtgggccaactttcatcaattaccatagtgaagcaaactagccgatatttttaagtctgaaggagtttttaacagttgaagttgttatttactatggcaaaaattcatgtacctacctacatttatatgtgatttgtttacgaagtccatgggacctcgtaaacatgaattgactcttagacagcacatgtgaaatgcctgaatgtgatctttctaaaagtaattcgatgttagtcaaattgaatgtttcattctaaactccattgaatttagggtatgtcaacattttacgggacaaatatgattttgtaaaaatttcacatggtgtgttttaaagttgaagaatttttttttttatatgctatatgttcaagataaggtgggtcagcatggaaaaatcagttgaaatttatgaaatttcgaatagcctcagagatgttcaaaaagaacctagtcaccttgttcatatttattttttcaagactttctaaagaagataatgataagaaaacgagttttcctatgtgagtgctacaatgtagcattcacagagtttcaatcggaactttcatcttcaagaaactatcaccaattttaatattttgtgtgaaccgaaaaaaataatcatccggtataagttagctgttttggcgacaactctactgatgtatcaccgtaagcattgtctgtgaaaaagctcggtttcgtttttccatgctgttcgccttatctttgacacagtgtacatttttatatatgtaacattttacttgtctacagagaagaaaatgatatatttttttgtaaatgaggaatgatatttttcttgtttttcggctttttgtgggacacttcatgtatgtgtatttttcattttttttacattggaaggaaaagaatagctttgttttgataaaggtaacataaaaataataacataaaaatcgaataatgaattttaagatacagcaggacttgatagattattccttaatatccacagtcaatttcatcacagataaaaaacttgattggttcaatttttccacaacatcatcttcacattaatatcttagaacaacatatagattcttaatttcaatctaacaacttttaaaatatctacattttcattataagttgaattacagtaagagatgagagtttcaaatttaatgtgattttctgtattcatgctacaatgaaggattttatctccctccaatttgaacagttattattccttatagttctagaaaatttttgccattcttcaagaattttgatagttgtattcattttaataaaaactctttgttgaataattttttctgcatataaaaaaaggaaattagaaaattgtaagggtagtgacttgatttctcagatctattttcatcagccagatcatttataatgtttaaacaataggtatatttacctaagaaatttagttttgtttggattttttttcgaaaaaatcctcagtataaagcccattctttaaacgaattgattcgatgtagcctccgactatgtggtaagagatcatcatgaaaaatgagaaataaaaccttgcgtgtttttttacttacttgtatttgtaactaatgttactgcggtttcatcctataagaacattttaaaacaaatgcaataaactcttattatattcgtttgaaaaagttcttataggacagaattacagtttcattagttacaaatacaactagtaaaaaacagaaagtttcatttttcttgattctttgaatatttacgtaataactgtcaagcaaacgttgaagttgcttttgattaatgtaatattaatggaactgaagcatgtaagagaaattctaggaatatgttatagctcttagttgttaattattcgaagaatacatgcatttcatcatatttgaaaagaattgtttaagaaacagcaaaaattatagtatagacacgcctgaagaagctattgtgtagcgaaacacgtgttacgtatttgtaaaactgtctagtgaaaatctcacaatgaagtgttcctttaataagcaaaaattgatttaggtttattagactttgctgcaaaagtgtctgaaaataatttcgataggaatcaagcagagtgatatggatcgtttagttgaacaatcagctaaagattgtaacttccatggtgcggttgttgcagaagagcgtattga

SEQ ID NO: 406 - DNA, 2211 bp, Leptinotarsa decemlineata
  Annotation=Cuticlin-1; Tribolium gene name from OrthoDB database=TC001440; Blast E-value Tribolium Gene vs. Leptinotarsa Unigene=0
tgatccatggcctcttgcaaccccggatatgccgcaaataaaacatttgcaagtgcagtgcgaaaagactcatatgcgcgttaatatagagttcgatcgaccattttatggaatgattttttcgaagggattctacagtgattcccattgtgttcatttgaagcctggaactgggcatctgagtgcaactttcgaaattttcttgaatagctgtggcatgtcctcgtcggctaatcacaatgttgctagctacggtggaccaacgcctagcgggagctatgtggagaacacaatcatcattcagtacgatccgtacgtgcaagaagtatgggatcaggctaggaaactgagatgcacctggtatgatttttatgagaaggccgttaccttcagaccgttccaagttgacatgttacatgcagtgacggctaactttctcggagacaacttgcaatgctggatgcaaattcaagtaggcaaaggtccctgggcgtctgaagtatcaggaatcgtgaaaattgggcaaactatgacgatggtactggctatcaaagatgacgaaaataaatttgacatgctagtgagaaactgtgtcgctcatgacggaaagagagccccaatacagctcgtagatcaatatggctgtgtggtgaggcccaaaatcatgagcaaatttcaaaagatcaagaactttgggccttcagcttccgtagtctctttcgcttacttccaagcattcaaattcccagattctatgaatgttcacttccagtgtgttattcaagtgtgcagatacaactgtcccgaacccaaatgtggccatggattgggtttgaccagtgaatacggagcacctccattaggtaacgcacttggtggtggagacttcggaggacacaacaatttgaatgcagagtatggaccaccaccttccagtgaatatggccttcctcctgctttcccagatcctagacatccttccggaccaaccggtgcatactctgaacaaaatgcagacgtagtaccagctccacaagctcaaacatcatcgtcttctacatccaaccccacaaattcatctcctgctcctcaggtatcttcacaaagcggtaacgatattcatttaccacccccaccgccacccggacaccatgggatctacaataccgtgaagaggaagagcaatattgcagaagagttcgagggcaacttagctacccttggaggtagacctaggtcagttgaaaatctaccagccgaattacaaggtgtgaggaggagaagaagtcctgatgtgatgacagtagtcgttagtcatgtatataaacgtgaggctcaagaaatgacggatgttaacactagtagaataattcaagtagtggcaccaggagacgtgaatttcgctctcaacgcagctcaaaacaacgaaactgtagttatccagtctgcttcttcgcaagatccagaaacaatctgcatgtcagtgccaagcttcgttgctggattagtaatgcttcttctagtactgatcgtagcaagcttagtagctgcgtttttgtttgttcgcgtgcgcgccatcgataggaaaggaatcgcccaaacttttgtcagtgctcgaggatacgataatgccgaattcgtgaaagtggctaattgacagtggtaatgctcatggtaggtgcattccaaaggttccaaagatgttcaggtttagcaagtggttcattcgcgagtaatcattttagtcgcagggagacgttttcttcaatgtcctaccaccttcttgatccaatcctagtcctattacagcatttgcttgcatatttgtcaatgctgatcgaatttaacgagaaaatcgataattattactaaaacagctcatgaggaatcattggcaaatatgccctagctctctccaccccgtcatctcattatttaactattaactcatcaactcattgtcgatcattcgtgctagtaaaggcattgtctctgctgttgctagcatgatctaaccttattgataagtaagttattttttattatttagttgttgttatttatgatgatagaaagtgtaatctacgctgtccgtatactacttgagggtctgtttgtaagatatttatttgaaaaaaaatttgacatgtcaggtctgaaataaagtaaagtgattttatcaactctgctccatattcaatctttcaggag

SEQ ID NO: 407 - DNA, 918 bp, Leptinotarsa decemlineata
  Annotation=Similar to TM2 domain-containing protein; Tribolium gene name from OrthoDB database=TC004488; Blast E-value Tribolium Gene vs. Leptinotarsa Unigene=2E-89
tttttcattgtctttaatgagcatttcacgaaatatacatacaggatgtttccaagtctataacaacttaaaaatggaccagctgtgaactgtctcacattatcattagggttaggtcttgaagaataaagcttcactgaactgcgaaattggaactacaaataatgaatgacttgtaagttttccccagaagaaaatgcgtggttacgaaacgaagtactcaagcaccaaataatattctttcagacatagggattccagttacttccatcttcaggagttagatagtttgaaacgagaagcacaatatccacaatccaccacacccccaacccaccgatcgtgagcaactttcccacagcggttcctgtctgtcccaaacaaaatcggtccatacccaaaaaacctaacagaatactatataacagagtcgttgtaaaatactggttggagtacttcacgcaaggaacaccatcccggagaaacgtcctgtttccaaaacactctatgttcggtagaacagtacacacgactttggctttctcaacttcatgaaactttgaacccccaaacttgaggcagccatggttcaattcgtcccttgcagttttgttacctttgtgatccactggttcctggcattcgatgaattcgatcgggagaaagtcgcatttgaccaaggggcccaaaggatcgaagggatcttggttttcttggggttgaagtatagattcactgttcactatatttatgagtagaatcttgaggagtgaaaggtatataattttcattgtttacgataccccaatttcaaattcgttgatgaggtgccttgataatatttagaagttcaaattacgtggtttctctattttgtttatgggttttccatttgaatagttaatgaagactaaagtc

SEQ ID NO: 408 - DNA, 883 bp, Leptinotarsa decemlineata
  Annotation=DNL-type zinc finger protein; Tribolium gene name from OrthoDB database=TC030565; Blast E-value Tribolium Gene vs. Leptinotarsa Unigene=1E-48
agtaatgaaattgtttttttaatgacattatttgacaattttgtcattattttttaatcgaaaatgaaatgaaatacaagtgaaaaactgtttttccgtaatataaatttgaagatgttatcacgtatagttactagtgttattataagaagaataaatgctcaatttcaacaaaaaaatcgccgttggcattaacctacaacaaaataactggttgaattttgttaaacattattcaaataatcccataccggaaatatattctccgataaaaaatgaaaaacaatctcaaccactggggaaactgaatggaaaactatttttaggatatacctgcaaagtctgcagtactaagaacacaaattacatatcaaaagttgcttatgataaaggagtggtgatagtgaagtgttctggttgtaataacaatcacttaatagcagataacttaaaatggtttactgatcttgatggaaaaagaaatattgaggaaatattagcggagaaaggagaatctgtgaagaaaatatccacaagtgactgtatagaagctctgaagataagcggatgattttttttgtgttcatttaaatcttgtaatatatttcatttttgcatattctgtaaaaaactgtatcttttatgttagaagaaaagacatttgtcttattttaaataaaataaatgataaatatgtaattccaatcatgaaagtaattgtgaaacatttttttgtccaattaactagttaattattttcttggaacttatattactttaaaaagaattaatttttttaaatttaatattaataaaccactgtacatctttatttggattactaatgaaagatatcaaagagaatgaaaagtaatttaaaaac

SEQ ID NO: 409 - DNA, 525 bp, Leptinotarsa decemlineata
  Annotation=Novel protein; Tribolium gene name from OrthoDB database=TC009143; Blast E-value Tribolium Gene vs. Leptinotarsa Unigene=0.; Blast E-value Tribolium Gene vs. Leptinotarsa Unigene=0; Blast E-value Tribolium ...
  ...Gene vs. Leptinotarsa Unigene=0; Blast E-value Tribolium Gene vs. Leptinotarsa Unigene=0; Blast E-value Tribolium Gene vs. Leptinotarsa Unigene=0; Blast E-value Tribolium Gene vs. Leptinotarsa Unigene=0; Blast ...
  ...E-value Tribolium Gene vs. Leptinotarsa Unigene=0; Blast E- value Tribolium Gene vs. Leptinotarsa Unigene=0; Blast E-value Tribolium Gene vs. Leptinotarsa Unigene=02
ttttcgcaacgagaaaaattgataatgaagtagagaaaagcggaagtagataaatagaagtacgcaatggaaaacgatgatatacatcttacctggaaaaaacttgaaagtgttgctaaaaagacaggcatgagagaaggcatttccgatggaagagaccaaaattttcaaaaaagtttcgacattggctttgaagaaggcttcaaaaatggatttcttctgggcaaattcaagggaaaattgatgggtgaagctaaacaaaatggttccgagttgaaaacacacccgcttctagaaaacatcagtagaggatcatgcgaaatatgcaaaaattcagtgtgggaagaaaatgttgaaaaccttcttgatctgcagagggaacgttacaatatgaacaatagaacactgattttacattcaaggaatacaagttgagaaaattttgttcttttgacgcacatcattattttgttcaaccaacagagtggcatcatcaggagatgatcttgggtgcagatcagattc

SEQ ID NO: 410 - DNA, 489 bp, Leptinotarsa decemlineata
  Annotation=Scabrous; Tribolium gene name from OrthoDB database= TC003194; Blast E-value Tribolium Gene vs. Leptinotarsa Unigene= 1E-96
catccacctcgtccaagagctgaaatctttcgagagcgaatacaaaagcatcgtgaataaattaccgaaagactgcagcactgtggaaggtccccccggaatctacctcatctctcccggagaaggggaaccaatactggcacactgcgaagacggctggacgaccatccagaaacgaagcgatggatcgatcaacttcaaccgaaactggaacgaatattcgaacggattcggatctgccactggtgagcactggctaggaaaccgaaacctccacttgctcaccaagctcaactgctcccagcttcaaatcaacatgaaggatatctacggtcagtactggcaagccaactacgcggatttcagggttgccgactattccatgggcttcaaactgaacattggacgatacgccggaaatgcgagcgatgccctcaactaccaaaacacgatggagttttctaccatcgacaacgacagagatatttc

SEQ ID NO: 411 - DNA, 484 bp, Leptinotarsa decemlineata
  Annotation=Putative uncharacterized protein GLEAN_07751; Tribolium gene name from OrthoDB database=TC007751; Blast E- value Tribolium Gene vs. Leptinotarsa Unigene=3E-24
atctagtgcggtttgatttggagatgtcagatcaaacgacacagttttaactccggagatattcaaaatgtctggtcgtgaggtggttcgttctcttctattttcttcggctcttggatcgaattcgtcatcgctcaaaacgtcttcatcagattttttggtttggaaggggtcagagttggatccgctagatttttgttgaatttgaaaaccacaaatggataagtcaacgttgctgcctccaagaagatccctgtcttctggtttgatcaaattcagatcactttctgagatacgttcatcagaatatattagattctcatcgatatctccattgactaaacctgatgagtgtaattcaccaaagatagttttgtccaacttgagatctggcaagatattcgcagcaaaggttgtatcgaatggatcgtcttctaaaagttcttcatcatttggaatgggctctgcctcaaaagcgctccac

SEQ ID NO: 412 - DNA, 477 bp, Leptinotarsa decemlineata
  Annotation=Protein stoned-A; Tribolium gene name from OrthoDB database=TC007751; Blast E-value Tribolium Gene vs. Leptinotarsa Unigene=3E-22
actctgggatgtacgctaacttgacttctcctgcggctatcgcatcaatgtaggcagtatcgaagataccgtcatcttcatcttcttctgactcggactctgagacctctacgatgccaagttgggatggagtaggttttgcaggctcttctttagcaacttctttttcttggactatcgccctagcagtctcttctgttctcctaacttcactttctgtcggttttctctggaagaaggaagtactcttgatccgatctagatctccctgggttttcttgaggatgtcatcaactccggaagtgagagcgagaaatttttttccactcttcgttttgtgctgctggtccttcctcgctggttccttggtgttccctgcggtagttctctagttcttccggcttaaatagctcctcttcttttcgtttggatttcttgccttttttcttctttttcaaacctttggttatcttgtgc

SEQ ID NO: 413 - DNA, 1165 bp, Leptinotarsa decemlineata
  Annotation=Dihydrofolate reductase; Tribolium gene name from OrthoDB database=TC030670; Blast E-value Tribolium Gene vs. Leptinotarsa Unigene=2E-114
gagtgtatgagtgacgttattgccaggacgttcaatctcttatcttaattttagtttgtctggagtcaatatcctctcttcaatggccagtccatatttataattcgtcactgacttcgatacaaaacagggttcgttacaaaatgcagaggtttcatttgaagttgtaagaattctaatcacacatggaaatcaggttctgactaattttttgataaatctgccgaacatttgtgatcaaaataacgttctgcattaaaaaaggaactggcgctttgaggcgaagtttaccaataatggaaaacgaaataggagcacctgcaaaatgttgtgaaagtggaaatattagtcaaaaagttagagtattggcaattcatggatacagacaaaatgcagaaacttttaagtcaaaaacgggatcgtttcgtaaaatgctacataaatggacccaatttacttacattactgccccacacaaagtaattttggtggatgaccccaatgacttaggaaaaagtgaaggtccagatattggtcaaagtaaagatgaagaacaatatggctggttcttcaatagagacgatatgacatttagaggtattagaaaaggtggaccggccataggttttgaggaaagtttaaaggttattgaagatgtcttcgaaagggaaggaccatttgatggcattctgggattttctcaaggagcatgttttgtgggacttctttgtgatctccaacagagaggattgacaaaattcaacttcagttttgcagtcctggcttcaggttttaaatctggaagccttcctcacctgaaatactacagtgatagaattaatcttcccactcttcacatttttggggaaaatgatcaaataattcctacagaaatgagtgaggcattgagtaattgctttgaagagcctatcattgtcaaacatcctggaggtcattatcttcctgcatcggcagcccaaaaacatgagtaccagaagtttttcaaaatacaattgtggcataaagaatacagggagcaacaggcagagaaagccaataattgagtaaaacgtttctaaataatttcattcctaactaaaatatgaatttctcacatgtaatatttgtacataattttatttattcattaaatgaatattatgtt

SEQ ID NO: 414 - DNA, 1648 bp, Leptinotarsa decemlineata
  Annotation=CDP-diacylglycerol-glycerol-3-phosphate 3- phosphatidyltransferase; Tribolium gene name from OrthoDB database=TC005756; Blast E-value Tribolium Gene vs. Leptinotarsa Unigene=0
taaacaattctctgtaataaataactgttgccttacaaataatttgcgtggatttaaaaataacttcggaatagagtcacatatgcatatacccatgcaggaattcgcctttcagtttcagctggagatgctaattcatacaagttggagcattcttcatggagactttttctcaaatcttcattttccgtaattatagccaactgtgattccaaatctttactaactgatctatgcccaaaatttggagatccaatcagagtcaaggatggcaattcctcacctggttggtaataccataaaccttttgcatgataagtccaaccacttcgaaggtattcaaacagtttgattcgatgttgctgtccttttttagaatatttctctttgaactctttagcaatcagtgagtaggcatacggaattcctcctgctggtcctttagcaccataaaatccattagcctttggatgtgccatgagaatatcacaatgtgctcgacacctcaggatcaaagtattcatatactgattcgttaaattgaaataaccggttgctattttcagcttaccaccatcaggcgcttcagcaaaaatcctgtcagttatttgtgcatcttgttctacacctaactgtcctatttgaatcaagggaaaaatccaagtatcaaatccttcttgtttatggacattttgactgttcattacatctacaaaatactgttcaattatatctccagcttgtgttacaaattctcttttattgccttcatatggtgacaatttccaatttgaatgtaactggactttattgtttttatccatctgtaaactgaatttctgaacttgatctattagtccacaataaaagtcacatagcggcttatcatcaataacaaaatacctatcctgtcggttagtaaaataatcattagataggttagcaccactaataataagtttatcatcaaaaatgtacagtttcatatgttgtaaacccaacaactcattccaacgatttggcatgtatttcttcaacaaaccacgtaactctggcgtgtgataaagagatactctacaattctgattgttttggagcagtaagggctgtaacataactctagaattatattcaaatcggcttcctctagtatagtcaagcaagactctaacattcaatttattacttctgaagtactcattgtccttcaccgaattgacaagtttttcctctaggttaccatttccgagatagagacttactaatgttatacgttctttagcaaagctgcaaccgtctagtagtgttttgtaaaatgtatcaggatctgtgataattttaacactattagcattaactggaaaacatggtgcaacatcagttagccaaccgaaaggtatcgtttctttccttgtgaaagggttgtaataagtcaagggctctgcagaggatactgtttcaaaaacactgtttagaagtctacgaatcatatctacaattcgttagtttataacatttgaaaaatatgaactttagtaacacctagataactaaacattttcaaatatagagaaaatgtcttatgaaaataaataatttccacactttaggttaagtcatctcagattgaaaaatttttaactgtggt

SEQ ID NO: 415 - DNA, 909 bp, Leptinotarsa decemlineata
  Annotation=Putative octanoyltransferase; Tribolium gene name from OrthoDB database=TC004433; Blast E-value Tribolium Gene vs. Leptinotarsa Unigene=2E-88
ttttactaggtcttgcacaatgaaatggttgaaccaattcttggaagggtgataattctttggatcacactgaacattctagcagtggaatcttactacctaaatcatatcaaattacgtaacttttcttgtcatctttgtaaccaattttttctactgccatatcttctaaaatcttttttgtatcatcattggagaaactaataactctacaattgaaaatgttactaaaactgtcaacgaactttggaatggcatcatcgatagtgacaatcctaccgacttctttggaaatactggtgacaccttttccatcaatcccgcatggtgtaatatggttgaaccaggacaaatcagttgaacaatttaacgccaatccatgagtggaaatgtagcgactagctctaataccgatagcgcatatcttgtcatttcctatccacacgccagtgtgcggtgatgtttcagcctttaggctgaattccttgcacatatctattactgtgctctcgatttttgaaacatagcatcttatgtttgtgttgaaatgcttcaagtttagtatcggataaacgactaattggccaggcccgtggaatgttattaaaccgcccctgtctgttttatagaattctgctcctttttgaatcaatttgatggcttcttcatcagaatactgtttcgttctgatgccaatagtatagacgggatcgtgctcaacacaaagcagaacgttgtttggctcgtcttttgttaggtgtaaacttgccaaataattctgaagagctaatcctttggagtaacttatcctgcctactttccaaactttgactaacctctccatttaaatttaacctcttctcactttccagtcatagacatttatagctttttccatcgataaaactc

SEQ ID NO: 416 - DNA, 1481 bp, Leptinotarsa decemlineata
  Annotation=Amsh; Tribolium gene name from OrthoDB database= TC011383; Blast E-value Tribolium Gene vs. Leptinotarsa Unigene= 5E-176
tagaatctgctatttaatctaaaattaatcacagtagaaatattcttcaatataaatataaatataacaaagctcttatgaaaagatatttggtgaagtagttgtagtttggtgaattcattaacctttacgtaaatccagaacttctagaggtgcattgttttcaattctgacgtggtcggccactttgaaaagaggtggctcagttggatgaggatgaaacccaccttttcgacaattcgcaatgaattgcaatccatgagttggagtcaaaatgaagaaaccagtttcgttatactttggagagcacactatcgcaatagcctcaggcataagtaactggtaagggcaatgagtatgaagatccacactcgacaggaatgctgtttgtgtgggatgagtatgaatccagcctatagttatgagattatgctgatcttgataatcaaatatttcctcttcattcattgtcatacaggaatcggaggttcccttttgcttaggtaaaatcatgtgtgttatgatcaattcattcctctcaagtttgcctgtcagcacaccacatgtctcaatatttttgaaggtattactttgtgccatggtttggaacaaagtcattactttgattggtacaactacaggccggaggatattagtatcatacctctcttgaaaactgatttctggtggctttttactacgatctattgtaggaagatcatgcagtctgtcaactgaaggagtaatcgtgtcatacgaaggttctgagggtagtggagcagatggtactattacattcgtgtctggatctgggtaacttatgtcatccaaatttcctgttactttaacaactgcagcagatctgtctgtcacacaagtcactggcattttgggtttttccgctcttctagttgcattttccttccttttctgttccagttcctgttgcttcagttctgctaaacacctattgtaatcgtcttgatactgatccagcaattgttttttcaatttctcggcacgtggcagaatttctctcagcttggcttgatttttagattttacctccactggtacagcattaaatccaggatgttttcgaattttctccagaaataacgtcatgaattttaaataaagaacataggaattctccagactgccttcgctataataaacgttcgccattcgcaccatctctaggcctgaacgatagtacctcaaaggggacacattatgatccacttccacttgattactatagtttattagctgcttcagcctttcctgaggttccaatttgtcaagaacactttcttttctcctttgagacatgttcatcaacttttatctcacaactattatggaacccttttgaaacaaatcaattaaggtaaaagagaattagatgtttattttccatgactcatagaacttttttattaggttagactgggtttagcgacgagaactgtcagtcc

SEQ ID NO: 417 - DNA, 1770 bp, Leptinotarsa decemlineata
  Annotation=Alpha-taxilin; Tribolium gene name from OrthoDB database=TC014163; Blast E-value Tribolium Gene vs. Leptinotarsa Unigene=8E-92
atagtgaaatgacttttattgtcaccaaattgttacaactctcaagaacaaataaacagcattaatacgaaaaaacgaaattaaaaatttcaaatgattctaaacatagagcaaagtcaaaataaataaacacagaacatgaacaaaataccctttgagaggttgaagaagcaaaaactccattattcctcttccttctcttcagtcttatcattcaagttcagaccagatactgacaaccccattgtaggatccggtggagaggcattcgtgaatccggcaacatcattttcctcacgtatctgatctgaggatttagcttcttcctctagagtttcagttgcactggagaggaaatcactactggtattttcttctagcttagacttagtatcacatttaacatttttgggctcatttcgctttgtcatttccattttatacatctctagtactttcttttttggccccatattgtcctttttttgagcagtaggttggggctcctcaagaagcttctccttctccgagctaacttcatgaatagcacctgcttcctcttcgaaatgcggaggaggtgtgaccgggacaatgttgttatcttttagctgacacaagtaagctgaacgttccacttgcaactttcggcacaacttttccagcatttttattttgcgctgagcagtttcaagatctgaagagcattcctggtgcagttcggttaaattcaatgcagattgagtagcagccttccatctctggtgccattcatttcgatctttctctaatgtagcatttgctttctgcattttggtcatttcatctttgaaagaatcaaaaaccttattgctttttttcatggtaatttcaaattctgaatactgcttctggtagacatcaatatggaactgcaatgtattaacattttcttggagcaacttgttggtctcctcacttttctccaaatttgacaacagaatagtgcgttctttctgccaaatttctctttctgtttcaaactccacgtctagttttttcagctgagtatcagacagcttcttctggagttccatttgacgattcatgtttgataaatgagtttcacgttcttgaaactgatcataaagttctgtgagctttgaggttaatttcatattctcttctcgcagacgcaaagacttgtctttattttcgtccatcagttgggtgagactgttgagtttttccgtgaaagtggcagctacttccttgcgtttatcttcctcctccttcaagcgattagaattttcttcctttatttccttgttttgtttctgcaattcacgggcaagactttccattttcgacctacttaggatgttttttgttaagtctgcttgaatatgctccttgtctctctgcagcacctgcaattgtttttcgattgccttcaacgtcgaagccgttgtcttgaattcattgtgaagatcacaatatttttctttgattacatcaagtttctcatcttcggagagatctccaatagcttttataaggtggtcccaagaccgcaagtcccgtttacttctttttacctttctgatagcgccggtactatcagaaggtcccactgatggctgactgcttactttgtcctccattataatttttgtgaattcttgatattgaaagaactaaatttcttcaatttctagcataattttcgcttttcttaggattttgtttacgaattcaaaactaggttatttcttaaagccttcacatgcgcat

SEQ ID NO: 418 - DNA, 1100 bp, Leptinotarsa decemlineata
  Annotation=DNA replication complex GINS protein PSF1; Tribolium gene name from OrthoDB database=TC016111; Blast E-value Tribolium Gene vs. Leptinotarsa Unigene=3E-99
agagtcgcagcataggttatgctgtggctgctgtggcaaagtagataatagtactgtaatactactatgatcaaaaagattatgcttcccaatgcaaaagaacgacatttgtggacctatggcctatcaaccgagctgaattttaaaccgaatcgtatgatatagttcctataaattattataactgctgatttttttcttttaatgaaaaaaatgtatggagaaaaggcatacagtttagtgaaagaactagcgcgttgtgaagacaacctaccaccttataatacagatttggtgaatgctgtttgtaatgaagtaaaacagcttgtagaagaaaatgagcatgatgcaatgacatctgctgaccaatcatcggtggggggatcagtagtacctaccatcaaaattcgacatgcagctgtaaaaaggaatgtgcgttgcttaatggcatatcactataacagactaaaatgtttacgcacaatgcggtgggaattcggaagtattttacccaccgagatcaaggcaaatctaagtgcatctgaaatagattggttctcaaagtattctagatctcttgcagcatatatgaggtctattggcgaagagggagttaatctgtctgttgacttgaagccaccaaaagccctttatgtagaagtgcgatgcttggtagattatggaagatttgaactgaatgatggatctgtggtactattgaaaaaagatagtagacactatctgcctcggagtgaatgtgaagagttgatcagacaaggagtttttgaacatattatataaaagaacaatattaactcatagttgtctagtgaaaaaaaatgtgaatgagggaacttatagccttcttcatccttcttcagtatttcaatgtttgtttatatacttcaataacaaaaatgtaagcgtttataatgtctccattgcttttttcttgttattagttattcatctataaatattaattatgaaactaaaatattcatttctacataaagtacacttaattttgaatagtagtttttgctcacaaaattgaacatcgataagactgaatgtatagatttttgagggcatcaaga

SEQ ID NO: 419 - DNA, 1721 bp, Leptinotarsa decemlineata
  Annotation=DCN1-like protein 1; Tribolium gene name from OrthoDB database=TC013916; Blast E-value Tribolium Gene vs. Leptinotarsa Unigene=2E-179
aaatttaaattttatttccataaacactttgttcaaaaacgggaaaaagagcgctatttacattgtttcaacttaatcttagtaataaatatgcaaaccaataacaaataatattaaatttattcggatcaatcaataattgatataataatctatgaaactgctttttttttcagtccagatataataataataattttctgttatatgtaatgcagaaaaatttgtactctaatttgaaaaacatgtacaatgaaaactgaatggtaatcacattcattcttgaaacgattaaaagccaatcaataaaaaaaaatcccaaaaacgtttccaactatttagacaaagtttgattcttccaacaaaaccaagtgatgtcattaaaacattacctagacgaatatacaactaacattaatctttcagaaaataatatgcataagtgataacttctatacacctatgactaaagaataatttatctatcatattctgcgaagaacaatatggaaattagtaattcaattacatatcgaaaattaaagaaacagttaacattccaaagcgaacataaatcctaatatcctaaggaagtcgcaatgaaaactctaaatgaaaaaactgaataacaacaaacaggttctccataattgtcagttcctaatctacaatcctggtcacggagataaaaaaaatgcaacaaacttttccaccaaaccaaaacctggactagcaattcaatttttgaatttctttcaaatttgacgaataaatttaatttcatttgaattaattgtagaacattctgctattcaagttggttggtactctgcggtcggttctctttagttttcgaggaagcccattctacaaaatcgtctatgagaactggccaagccccctcctcatcgtaattgctcatgtcatcggctatgtgttgagcaaagtctagaagcaaattccaggtgtctttaggaattgacctcctatgattctcctgtaaaaaagtacaccacaaatccagaaacttaaactttcctttcagaactatattccaatatgctatggccatatcgagatctagtcctttctgccctgggttcttggcgtaattgaacgtgaaatggtagaagtctttgaacttataactatcccttaattcgttttctaacgcaggcaatcgtgccttcaatttatcaatattatcacaacctaaatctgtcatcccattcacgaactcatctctggtgaactcgcattgagttgcggctttgaacttccaggctatgatgagcaccaatttggattcgggcggcagactcagatcatctaagaacttcatgattccatctactgttaccttttctggctcgctgggatccttgtatctgttatataacgagtccaacttctttttatctacgtttcttggctccttgtaatatgcatctgggttttggaagtagttgtcactagctagatctaatttccaatcattttgagtaaggcaataaatggctgtattttcacccgtctgggtgaaggatataaacttttttactttctccctttgcgatgatttgagtttatgcatagtgggaattaggtaattcacaaataatttattaacaaaaagaaaacatttgattattatttcctttattgttgcagatttacgaaaaataacctcaactaaagtgcgcataaacaaggctaccacc

SEQ ID NO: 420 - DNA, 2914 bp, Leptinotarsa decemlineata
  Annotation=Polyadenylate-binding protein-interacting protein 1; Tribolium gene name from OrthoDB database=TC003208; Blast E- value Tribolium Gene vs. Leptinotarsa Unigene=5E-73
atgacataagccagttgtcttctgtcaacggagtttttcagaattacaaagtttgtttatttttgtggatgtgttgattgtgtatttgtgtgtcgtcgttgagttatatttcaatatttcagattcaacttattttatgaaatttatcagataaatatccatttctaaatctgaaatatggcagataagcccatgttgtggaatagaaaaccagaccaggttcaatcaagtttaaggccaccaaaagttgccccaaacaaagttttaaacagttcttcacattcgaatcctcactcagaaacaaaagtggatatcaatgaaactgttacagaggataattcgaatttttcattagagaaaaacgtcactgttgaagaattggttgcgaattcaaaattaaaagtagaagctccagaatggttcccttccggacatacttatgtaccaaacaacagaatcgagaagcttgctagcagcgtacaaaatcgattgaaaataaataaaacgaatgagagcaatgatttcgaatatgccactgttttgcaaaacatggaagcaattgaaaactcatcagatttctggagattgaaacaactaataaacacgctaacgaaggacccgggtcagttcgacgatttgttagaattattcctggaaactcttgcaccatattttgacgatatcatagctttatcaacgatagtaaaaattttacttgaacaggcaatcaacgatgccaacttcaggtacacgggagcccggttatgttggtatatagaacagaattgtccacaatttagagcggaactacatatgggctgcaagaagcaactcgaaatcaacagtaatacccagaacgttctcttattcattgcagaactttttactcagctaccccatcacaatgtgtatggagcattacttatagattctttcagaaatttattcgccaatggaggcgatgacaacataaagtgcatttgtcaagcactaaagttaacagggtatactttagaacaaagtaataagcctgatttggatgcagtttttgacaagctgaagtctctaaaaggcactgtaagaggctcagcatccacacttctagatactgtttttaatttaagatcatccaattggggacattcgagtgatgtatccgaaaacgatcaagaatttgacggttttgtttatgatggggaccaaactacagtatttttcaatgcagagggtgaagcacttacacatgaagaaagtgagttcatagcagctcatatgcaatctaatgatgacattttgagcgacccttctgatctggatgaactgtacgatcccgaagatgaaatggacgaggagattcaagaagcttttagagagtttgtcaaattcagtagtagtaaaaactaatttaagaacttgtgttggttgaatcatttcttgtagtaggtacaatgttcaggattttcagtagactaactgagattttggtttaaaatcaatgagcgtctagtgtaaaatgcaaatgagcttcaaggattgatttattggaatgttgactagtcgatagagtgttgaaagttttataaatcaatgtaaaattaagtagttatagatcgaaattataatagttttgaatcaaattcattgatgatttcaatttctctcaatatttcattcgaaggatagaagcacatttctcattgataaaatggaaggatattcaacagaaaagatgtcatgaatttatttatttatttatagaatatattttccaaaatgttgcaatgcgatgttgtggttggaagcagagcataagttatactttaactttgctcagtcatcactagtttggataaaattcatttccagtgtgagaaaatcatgtgcttgaaaatttaattttttaggaaaatatcaatagagtttctagtatttatgaaaaatattgagcacaaatattttcaatggtgaaatgtatctatgttatataatttgtattttttttttgaaagtttccatgtttgttgtcattttatatatctgatgtttttaatttattcctaacgcgagatggtgaaaaagaaccagttagtaaattgttatgaatcatgtaagcgcaagtgaatatattcatatgtagatttattttatttttattttttaaattaaggaccagtgggcaacatctaggttttacaactctaacattgttgttcattggaatcattgaatattgattgccatattatgaaactatagacacaaataatccagaattggttattttgaataatgttaaaattcatggatagagataactccgaagtttcgggagtttttttggccgtgattttcttgttttgttgccttacgtttcgtgtatacctgcgggatatatcaaaggctacaaggtaacggtcacttctatcgtatattaccgagaccggcaccctcaaccatgtagtgtgcgctgtggatcgactagagcactgtgtccattgcttcgcctttaatatctgccgcagttctagataaaacgttgagcatgaaaaatctgcaggcaacagataacatacctgtaaaatagatgatgttcaatgaacgtaactaatagtttatattccggaaaatgcagagctttccaaaagatccgaaaattgcaaacaaatgcaatgcagaaacagtgaaccaacaaacatatttatatgttagtgacgtcaaatatccaacttatttcttggttttctcttagttttgcggtgatcttagcatcagcttgcaactaaggtccttcctgtttgaacttgattcaatgaaggtgcatatgaatcaccttcttaagaagtgcatatgaggtgcccaagatctgttaaaaatgccaatctcctgccctcgtatgcccctctctagagacacg

SEQ ID NO: 421 - DNA, 1015 bp, Leptinotarsa decemlineata
  Annotation=Haloacid dehalogenase-like hydrolase domain- containing protein 2; Tribolium gene name from OrthoDB database= TC003810; Blast E-value Tribolium Gene vs. Leptinotarsa Unigene= 1E-122
gaagtcggatatctccacttgcagaggccaaactaaaataatgtggttatagcatctgttatctactcattttttattaattttacatcttattcaaattaacggaaacataataattggagtttaaaaatgattcgagctgttctggtagacttgagtggaacattgcacatcgaaaatcaggcaatacatggaagtgtggaagccctgaaaaaattattccagaagaatatccaggtcagatttgttaccaataccacgaaagaaagcaagaggattttatatgacagattaatgaatttgggtttcaagttgaaaaaagatgatatattcagttcactgggagccgcacgatcactgattttagaacgtaaactaaaacccatgctaatgctctcccctgaagctttggaagattttgaaggactagcttgtcctaaaaatgaatctcccaatgctgttgttattggcctttgtcctacggagtttcattatgaacggctcaacgaagcattcagatatctgcaagcaggtgccaagttgattgccattcatgctggcaaatattgcgcgagagctgatgggttagctctaggaccaggttgctttgtcaaaggcctagaatactctgcgcagtgcactgccgaaatagttggtaaaccaaataaagtatttttcacgactgcgcttggagacgttccaccagaagaagctgtcatgattggagatgatgtgacggatgacattcaaggtgccatgagtgcgggactacaaggatatttagtacaaactggaaaatacaaacctggagacgagaaaaaattactccccctccaacggcagtattcaaaagttttgttgaagcagtagaaaatatcttgactcaatgtgaataagcaaactttttccttgagaatgtttattcagtaaaattaacagcatatgtaaatagtatttggaaaaataaagttatttattacattttaacaatacataacatcgattacatcaataa

SEQ ID NO: 422 - DNA, 1528 bp, Leptinotarsa decemlineata
  Annotation=RNA-binding protein 40 (Fragment); Tribolium gene name from OrthoDB database=TC010372; Blast E-value Tribolium Gene vs. Leptinotarsa Unigene=3E-152
tgtagcagatctagcgaagacaacaactaagggcttatccttcagaatatatccgttggtctctttaacagctttctgagccagttctacactatccaaagtgacaaaagcttggcccttcatcctgccttcttgcataagcctgatatcaaattgacttgtagtatttccatcatgaattctgtacctgttataaataaactcaagatctcccaccaccaccgattttgcacaattttttatgtacagtcggcatgttggtgcccctggatggtagtttttgaaaacaggtaaaactccaagatctttatgagaaatttggttggcagccaattcttccgctgttatcgcagtaatctcgttttctatttgttttgtagaagttggtgacgattctgttttttcagaggttggaggttttaccagaggcaacaatattccaaaagaaccagttttctcaggttcttgtacaggcctttgttctaatgagtctggggcaactttaacttctattttcttaggaacttgtacattcaccttttcaaatacattttcagttttttcagcaggtttggcagcagcatttgaaagttgtgccacaggaggcttaataaacttaggtctcttaacaacttttttctgtgaagtttttctttttaatggagtaaattctctgttcctgaagtaatctccatcatcactttctaactcggattctgaactgctctcaggttttttatcttcttcgggtaaactagatgatttcagagactgtttcattacaggatgctgtgatggtgttatagtcctaacaggtggttgttcaacagcaaaagggggtggcagattcattcgattcattaaatgtaggacttgagtgtaaaatctaggtacggtagctagagcatgagcaatattattgattgttgctctatttggttttgggtacaagtatttgagatgagagggaggtggctggtgaaatccaacagattcattgaaagatgttaatttgttgatgaatgttttgaatgatttcttattacttatatcactttcatcgatctttttacacttaggcttaccctgtaatatatcattttcagcatactctatgcacaatcgacaattaagtacatttatttgatgaagcctaaagagaacattttttgccaattcctcggagtcaaacttggcatatactactgacttttccttaactcttgaagttataacttttatactgcttgctccaaaatgacgggcaaaatcttctttctgggcgtcagataattccttgggtaaattttttattttcaaggtatctttgcaaaccatgatttcttgactagtatccagttaatctgttattgaccaccagaaataaagatttgtaaaattttttatgtttattattacatactattgttatgaaaaattttaaatcaaatatgaagatacctctactaaatttatattaggaagaagagcaaaatacacaatgttatgaaaataaaattccaaaacc

SEQ ID NO: 423 - DNA, 473 bp, Leptinotarsa decemlineata
  Annotation=WD repeat-containing protein 85; Tribolium gene name from OrthoDB database=TC006759; Blast E-value Tribolium Gene vs. Leptinotarsa Unigene=4E-32
tcatcctatgaaattgatgctgatacttcagagacattgattttatctttagactggtcttcagcaatagacaaatcaagtgaaccagaaataatttgcagtgattcaaagggaaatgttcacttagtacaattgagcaatgaaacaatattattgaaagaaagctaccactgccatgagtttgaggcctggatagctggtttctattactggaatactaatatattctttagtggaggcgatgacagcttacttctgaaatttgatacaagagtgggcaacctgccggtatcaaaaaacagaagtcatggtgcaggagtaacatctattcactcaaatatttctaaggagaatattctagctactggaagttatgatgaacatattcgtttatgggacattcgaaatatgagagctgaaatgaatttaatcaaaatgcccggtactctgtggagattgaagtgggatccttt

SEQ ID NO: 424 - DNA, 932 bp, Leptinotarsa decemlineata
  Annotation=Rap1 GTPase-GDP dissociation stimulator; Tribolium gene name from OrthoDB database=TC002934; Blast E-value Tribolium Gene vs. Leptinotarsa Unigene=3E-92
acaacatgtgcatgcaatcgtctccagttagtataaccacaatgaggtcacaagccattttcaagagggatctgctatcttcatcgttaacatgatgcctatacttctctataagttcaaatagaagttcacagacaccttctttggctagtagagttttgatttcatccttttcagactggccatggaaaatttcaatagccataaccgacatttctggatttgtagttttttggaatatttcaataacaacttggcacaggctttctgtgaagggtatatcttgttcgtccaaatagttttcaacattggtcaaaacagataggagaaatgataagagaatttcattttcttcaagggattcagaatacttgtgtagtaactgttccaaaattggcatcaattcgttttttagagctgttcttattattccatcattcaagttgaatagattgacaaaaagacctgcagttttggtagttagggcattatttgtttgttcacagtctgccttgagtatcgataaaaaattatcgacaccaaatttgccaataatgttacaggcttcctcattctcataacaaatatttccaatggctcttattacatgcaaaacaacatctgtatcagtgttttctaattttgttagcagtttactgatcacttcttcattggtgagaacttttcggttttgctcactttttgcccattcagcagttacttcagaagccagtttgagaatttcatttttatcaattttcagtaaagcatttggtaaatctacattattcaactctatgttggtattttccgataatataattttaaggttatcgattatttcttgttcgttgagatcttcagttgctttagtcaatttttttaataaatcagacattatttggcaatcctttcataaccatttaaaaccc

SEQ ID NO: 425 - DNA, 1144 bp, Leptinotarsa decemlineata
  Annotation=Negative elongation factor E; Tribolium gene name from OrthoDB database=TC003247; Blast E-value Tribolium Gene vs. Leptinotarsa Unigene=9E-133
attcctttaataaatcttagtgtcagattagtcaattgttcagaaatagttccgaaaacataaattctatgatcacaaaaatattcaataagtagaattaattacttctataattaatatgtataaaatttcatcaatcagaattttctcaccaattccatgaaaataattaatattcttctcaaacaaaaagtatgagaaatatgattggtctatggtcttcaagagattgttttctgcttcctaatcaaacatgtcatcatatgtaaccaagttcctcttatccctgtgatttcctttctgagagtgactggatgctaaagtagcccaggcagcggatgacgtggcatcattgataggttcaatttgtggttgtcttctggcgagtgaaactttcaacggaattcctgataccatgctgccatccatctctgatattgacctctcagccgcatccaccttatcaaaagttataaatcctcgatttttctcaatttccatagaaatatttataattgtccccatggtagaaaaatgtttcttcaagaactcttcggtaattttgtacccagacacatatatggtatttccttgtctgggtttgtctgtcttctgttgctgctgctgctgtttttctgtgagacctctttcttccctatcgcgtgcgtttgcgaaagagtcatagagatttttcaatctcggtggtttgttttccgggttgtcagggccatcatcgctttgaacggctgagaaaggttggtatccgctaacgattttgtcggaaataagctttcgctctaagcctcttggtcgcttgaatccttgttcaggttgcttctgttgcttggatatggcagatattactccagattttatcagttttttagcaacttctctggcatctctggcttctgcaggtcttttaggtataatgggcttttctggttcaggttttggagcctttagagcttgtagagcttttttcttcttttttagtttctggtatttagcctgcaacatgagttcctcttcagtataatttgcaggaaaatgaatgtacaccattattatattttcttgatttaagtattatcaaagtcaagaagtaaacaatatccaacaattaactttttttttgacaatc

SEQ ID NO: 426 - DNA, 722 bp, Leptinotarsa decemlineata
  Annotation=M-phase phosphoprotein, putative; Tribolium gene name from OrthoDB database=TC013316; Blast E-value Tribolium Gene vs. Leptinotarsa Unigene=1E-28
ccacaatgatgaattataatttcaatctgtactggaatattatacaaaaatacaacaatcaacaggatgatcatgaataacggcttggtgttgaggtaaaactagtaatattcattaccacaccaaaggttacaaacagtgcatatcaaggatgatcatggttatcagaactatatcacataatttcttacattatacaataacgttagtttagagaagttcacccttatttaaagtcagtaatgttcacagaacatattaatacctttcagctataaaactgctgcaaagattactttcacagaatatttattgaaaatgaaccctaaagattattcttttccttcaaacagtcaacaattttagtagagcgtatcatcggcaggtttaacaaattttctatcagcctttcttttgcgctccctattagcgccatgaaactttttcccatcgtgttcactaacgttgagtatccttcagccatttcaacatcagttatatctttttcttttcgttttttcttcatcttccaactgtttgccataatcattagccatcagtttttctatttcaggattcattcctccaaaagataatctgccatcaacgagagttcttatgtttgacatgctggttgaaacaaacacaagatttccagaccttctcatttcttcggttatctcactggaatacatgatatgcccttccaaatcatccttctc

SEQ ID NO: 427 - DNA, 1464 bp, Leptinotarsa decemlineata
  Annotation=Regulator of nonsense transcripts 3B; Tribolium gene name from OrthoDB database=TC000872; Blast E-value Tribolium Gene vs. Leptinotarsa Unigene=3E-83
atattctacataaatacatattcaaacacaattatccatttaatacaataaatcaaattcatagtggataaaacaaatagtcaaaaatacatttcataatttttcatcacttttattgtctttactttcatttccttcagtttcgttttgcctcctctttgataacattcccggtcgatatatggcaatggtgggcctatctttatttcttatccttttctgactctgaacatcgggttcttctttcttcacatctttttccacttttggctttggtggctcctttttctcgttacttataccaggtttttcttgagggggtttctgagtgtctgcttgagggggtttctgagtgtctgcttgagtctcgttcaatgcttgattgatcttcttttgttctgccttttgagcctctatttttctctcttctcttttttcactatactttttcactttcttgggaaatacttttgcctctacttcttttctgtaatcagttttagagcgggtttccttctccttgtggtcatcatatttgtagtcacgattgtcataataatccttcttagggtacctaggttttatatctttgcgcctatcttcaaatctccgttcttcatactttctctctctgcttttataataggacttctcgtaaactttttcactcttctcttcaacctttgtttcactttccccttctgcttttgaattatccaccttaggtttgggccgaatctcgggatttgttgcaggtgacttttcatcgttaactcttttacgatcttctacgaaacgatcttttctcttgtcaaattctcttcgtttcctttcttctcttctgacttctctgatcctcattcgttgggcttttttatttttaatgaattctaagaggggagtagtaacatcatttttattttcattagtcaactgaagagtgtattctggtttttcttcaacaggctctacaggtttttggagagattcaacaaattcggtgtaaattgggtcagactcgatgcttcctgattttggatcaatttttgtctttcctcgctttttagggatcttttggaaaggggcgaattccaccacacatggatattcattgcccttattgtctaggaacacatagttatcaaacctttccttaaaatcgtatatatcctcgtgattgacaaagttaatataaactcttgagaaggcaaactctcccagagaaaagtctccatttacagtgtatatgtaattgtagtcaggtaagggagagacttgttttaaaaaagtgtctttatctatagtcggaggtagtcgacgaataactacttttgtcaatggtttttccttcttttcttgctttcgttcgctttctgtaagagccatcaggacagatcaatggattaaaaataatcacttaaatattcataaataagtggaaatctgaatacttcagtaaccatt

SEQ ID NO: 428 - DNA, 788 bp, Leptinotarsa decemlineata
  Annotation=Coiled-coil-helix-coiled-coil-helix domain- containing protein; Tribolium gene name from OrthoDB database= TC002433; Blast E-value Tribolium Gene vs. Leptinotarsa Unigene= 2E-63
aatcaactctatgtaacatttatcacacacaataaaccccttccaaaataagatattgttaatataaaggcaattgatacgaatttattggcatttcatatttacaaataataaaaacaacctaaaaatgatcactaaaagatgaacaactcatttcgcttcttcatcctctgtttgctagtaaacaggatcttctcatatccacacattcttgaaaagcctggactatcttcgaacatctcatcgattcatttgggtagcactgataacattccatcactgctttttccgattctgtacaaggtggtagacttttttcttttacaactgtcttgcttccttggaattgttctactgctttattatattccttatccatgatttcattcatcttcttatgactggcttccaacgctcttattctgttttcccaatattcatcatttttcttcagttctgctacattttgctgccgaagttgaagtgtggttagactaggttcattcaaaaagtatggtgtagtaatgactggagttccttgtgggggaaatgcggtttgattcttctgcaaatcttgtcttaccgtttggttccctcgtagacgatcaacaacatcttcagatactttaatcacattatttgggtcgtcattttcaacagttaattttctagttttacttgtagaaccacccattttaatttcaaaattaaagactatcgaaatttgtggccataacaaattaacattgcggatattgacagtatgacagttgatagttaacttcacc

SEQ ID NO: 429 - DNA, 3211 bp, Leptinotarsa decemlineata
  Annotation=Protein tyrosine phosphatase type IVA; Tribolium gene name from OrthoDB database=TC004794; Blast E-value Tribolium Gene vs. Leptinotarsa Unigene=8E-61
ggtacgtacatgcatgattttcaaacattcttgtttcgcatggttgacccgttgtatctaggtactacctggtgttattgtttcccttgtcacaggaaatttcgcgtgagtcacagtattctgatctgatgagcgacggatatgtaatgataaacacaaaatggccgactacgccatgatcacccacaaagggttcaagttcctgattacgaaaaatccatcgaacaccaccttggacgctttcattaaagaactaaaaaaacacaatgtcaaaattgtcgtcagggtttgtgaaccgacctacgatacagaggctctcaagggggccggaatacaggtgtgcaacctgaacattccggacggtacttctccgtccgagaagattatagacgaattctttgatatcctcaagagacagtataatatcaatccggaatcttgtgttgctgttcactgcgttgcaggtcttggtagggcgcctgttatggttgctgtagctcttatcgagttgggctttacctatgaagatgccgtcgacctcatcagagagaagaggcgaggcgccatcaatgccaagcagctagaatttctctctaaatacaaatcaagatctcggctggtcaatgataaaaagaaagcttgcataattcaataaacgttgatgacgaagggtggctcatatattacatagcttactcgaaactgcgactccatctttggtcaatgaataatccagttaaagagaaatgtgatgacagtataggaaattgattgataattgatgttggttgaaagctgaaggggtaattttgacatggtctagaggtgtgctggaaagtgtaagggtggcgcagattcagtctgatcatgtgcaatttgtcaaagtagatagcctgtaacttgtttggcattcttggtaacacctctactcagattaattgattgaaaaataaatatattgccgcagaattgcaccgtgcaattgcatctaccatttttcatccattttcattttataattcacgcaaagagaatagccgttaatatacctaacatagttattgaatttggcaaatattctcttgaaactcttcaaaatttgtgaaaactccagatagttttcaatttcgtggataactaactgacttcagctgagtagattattgatttcaacttcagattacggttttattaccaatgaactatcctaacgtccatttaagagacacacacacaatagtttctcgcgatatatatttggaagcgttaaggtatcaaaaacaattattgttttaggaagactgaaggaattcatttccatactagtccaaaggtctttgacatcacataattaatatgaaatatgtaattgtttctagttgtaaatattcagttaatagttgtgtatattcagttaatttgtatatttaatagtagacgttataataatattctatatttcaattggcttacaagtatctccttatgtttatattgtaggataaaattaccttccaattatatatattcttcatttttattgggctatgtcttactacagtatcaaatttttccactattgaacattcaaaccatttagccaaacaactacatcaacaccaatttccttctcttgaatttcttttacttttctcaaggggaatcctaagaaaccctattcagaaagtatggtttgagggattatttcctacatctgtaacagcattcataaaaaatctttgaatgtatgaaacttccctgttattttccattatatcaaatattcttaagaacaaatctgacccttgttttaagaattttaattattcgacaacaaaacattcaactggaattttaacatttatttatgatacaaattatcaatttgatctctctggtatggctctagatttcaaattaaagaagtctagtgttttttgtgaaggggtcgcatttccaatgcactattcattcatttatttcaatcgttttgtatgagccaccatgtgctatactgatttttaggcaatgaccgaatttggccattgaaatgaaatcaatattattttaaaggtttttgaaattaaaacgaatcattatgtttaatcaggttttaatgttttgaggcaaaagtgtaatttatactttgggaatcatgttttctattgtaaaaactttcacaaaatagttcaagttacatgtagtattgaacatatttttggcttcattcacgaggggtgacttgaaatatttaaaaaagtatttgaggcatatacgaacattttaaacttgtaagctacactttctgtttttatgcaaaaattaatttttaatagattattttaatatactaaaatgttatttcattttagttgaattgaggtaaatttgcaccacttactttcaaaatttcttgaaaatatgcaaaagtaatcgcagtgcaatgaggagacttatttcaagtccaatactctttgtgttttctgtcgatttggcttttatttctgcttctcggaaataattgaaacatttttttttataagcaggaaagtcattatggcagagtaaataatataattgttttttcgatgcaaagacaatggccaaattcgtgtattgcaatgactcttaaaacagattttctgtttaccatccaatgagtggatgatgaattgtatacacctagtgaattgtcaaagcatcagaaaagaaatgtataggataaatgtctgaactttatgattaatgactaacatttactttttggccagtaatttttctccaattccttactttggcaagaaaataaaaaatgaatgtagtattgaaaaaataaatcatatattttttaaattaaaccttatcaaaagttggcttgttgtttgaagttcctctgaggtgagttggactatcattactttgccaaattgtttatcttattgttattgtcatatataattttctcaaaactgcttccatcaaaaagttatagataattttgggaaagatctacctattttttacacaaagtcgcccttttttaaattcgacaattacattttttgttgcaagaaaaagtttttaactatgattattcatgtgaaaattttagaagaaagacgtattttcccaaatagtattaatttaatgtaaagtattgaataatgtaattttataaacgaatgtcttttttggaatacaacgtatatca

SEQ ID NO: 430 - DNA, 1037 bp, Leptinotarsa decemlineata
  Annotation=Splicing factor SPF30; Tribolium gene name from OrthoDB database=TC005331; Blast E-value Tribolium Gene vs. Leptinotarsa Unigene=2E-12; Blast E-value Tribolium Gene vs. Leptinotarsa Unigene=0
tcaatttacatgacttataaaatataatcttcattagttcaagtagattttcagaatttatttgacgtttcatatgtacttataattttctatttaaaatttaaacattcagaaaaaaatgaatccaaaatttcaagtcctcacaatttattaatctcatcttatatcttacacacctttcctccacttttcagcagtagtgaattctgtcataggtttaccgctaattccgcaagttccaattcccactcgaccattcacagattcaggagatgcaaatatgcttttagttttcagacccgttttcttgtttttaactgctttactcgcaaacgcaagccacttcttcttctccccctctctttcatcctccaactctttgaatcgttgctgctttttgagtttttttttctttagatattctttgttgtgcatttttgctttcttcatcttttccgattctgaaagtactcgtttctgacctgtgaattcacgaagttccgaaagagtagtaacacctcgatttttaaaagcttcaaatgttacatttacctgtccgtctggatttatagcatctatcctagcttcatagtattgtccattatcattccacttggccatgcacgtgtcaccaagcctccacatttttttagctctatttcttgcaacaaactcttcaacagcaagaagagatttcgtaatttcatcatcttctgcaactcctactggttcggtgtattcaggttgattggcagcttcttcagctttatttttgaggtctaaagtgagttctatcacctcattcaaatcgattttgagcttttgtagttcttgattatttggatcagtcaaaagagcagcctctacttgttgcagttgtagttgataattttgcaattcttcacacatttttgttgctcaaatatgaaatgctaacaaataaaatatcactatatcataggtataggaccgaaaagtttaaataacaattatttacttcaccttacattagtaatatatctaacaagtgacattat

SEQ ID NO: 431 - DNA, 1032 bp, Leptinotarsa decemlineata
  Annotation=Wnt6 (Fragment); Tribolium gene name from OrthoDB database=TC014086; Blast E-value Tribolium Gene vs. Leptinotarsa Unigene=1E-55
ggcagtcatggggctcacctaagtgagtgtgtgagcgcgcgattatgcacgccgtgcttttcgtgcccgccgtctaccttttgcttcttctcacccctttcacgactcctggtgggccgctggcagcttcttggtaatggatccaaatcagacatgcaagagagcaagatggcagagaggaaaaatggccgacatttgtcataacaaaccaggtctattgaaccaaatagctaaaggtgttgctcttgctcaaacagagtgccagtatcagttcagatatagaagatggaattgcacaactctgagaaggagtatcaaaaaagtcatgttgagagatacgagagagacaggtttcgtgaatgccattgtagcagctggaataaccttccaggtgacaagagcttgtaccaaaggtgagcagataggatgctcttgttccaagaggaagaagaaaagaaataaaaagaaacataccaatcctcccttgcctgaaggggattgggaatgggatggatgtggggagaatatcgaattcggtatcaaaaagtccaaggattttctggataataggtacaagaagagaagtgatatgaaaactctagttaagttacacaactatgtggctggacgaatggccatcaaaaatcacatgcgaacagtctgcaagtgtcacggtctgtcgggatcctgcacactgaaaacctgcaccagaaaaatgccaactttcagagaaattggtaaccgactcaaagaacgctttgacggcgccgccaaggtcataccaggcaacgacgggcagagcttcatgcctgaaggcgaaaccatcaagccaccaggtcgcgtggacctagtctactcggaagaatcccccactttctgcgaaccagacagcgcgctgggatcttttggaaccaaggggagagtttgtaacgatacttctcaaggagaagagggctgtggaattctttgttgtgggcgaggtcataagccgcacaacgaggaagtgaaagttaactgtaactgtacgttcaa

SEQ ID NO: 432 - DNA, 1582 bp, Leptinotarsa decemlineata
  Annotation=UPF0609 protein CG1218; Tribolium gene name from OrthoDB database=TC007171; Blast E-value Tribolium Gene vs. Leptinotarsa Unigene=6E-117
gaatcaatctatcaacagacaagtttaaacacatagacgaaaattcgtatgtttgaattcaaagttttcaatatttttttgagaagatatgtcggaaattaaagcacagtacgaaaaatatgttcaagatcatagaataccatgtaaatacggagttaaatgttaccaaaaaaatcctatccatcatgaaaaatataagcacccaccattaaagaaaaatgaggataaaaatccaaacagacatgctacaaaaaaatttaaagcagagaataaggtcataaggaacactgagtcagattcagataacaatgataatgacgaagtgagtgactctagttctacaagtcaaaagaataaaaccaatgtgaataatgatgtctctgattccgatcagggtagttcctcaaaggaaggccaggataactctgacaatgaatctgatgattgtggagatgagaaatctgcaaatgcttcctcttcaagcgaaatggcgactgaggaggaaacgaagaaaagcaaatgtaaaaatgacagtgaagatacctgtgcagatcaagaaaaggaagatactgaagagatgataactcaccatgcaactgaagaggaattacagtggtcaaaatttataaagaaaaattcttggtatcgatgccaaaagacttttatcagttttggatattttgctcaaaattgaagccaaacaatggcttgttggccttgagggatgttggattaacactagttgggccatttgatgtacttgcaggcaggtttaagaatgtatccaaatccgacgatgagtatcttatccactggcggtattttcgtgatccacctgaattgcagacagtattaaaaggagatgatcgtatcggatatcatatagggtattttagagatacccctgaagaaatgccggtatttctggttagcaattcagcaaaaaaagatggaactttgacaccgatgggtagtaacatttttgctgctgtcaatttttacctggatgatttgaaaaaaactggtgacccattcaaaaaaatgcacataggaagaattcaagctgctttgaagaaggaagttgaaaaattgaaaattgacctgtcaaagaagaataagaatatcattgagcgagagaaaaaaattgttgctagaactctgaataaaattggacttgtcgttccatacaataaaaaaacagagttggggtacagagaactagctctgaataacaaggatttgaacacattattcacaaaactggaaaattccaaatctgatgtagaaaagcagaaattactttcggacttgcagccagttttcacattttccagtatagcaacagatgaatgtgattttggaacgggaatcgagcttgggtggaacattataagtcacggagttgaagacttgaaccgaactgctgaaagatcactagccataaattaccgtctgttaaaaagagaagctttcgcaagaatcgctgaagcacatatgaaaaatcggcgaaagggatgtgatttgagtattttataaatcatcatgaaagtgaatttttttttgaataaatatgacattttgt

SEQ ID NO: 433 - DNA, 1061 bp, Leptinotarsa decemlineata
  Annotation=CG7864; Tribolium gene name from OrthoDB database= TC030620; Blast E-value Tribolium Gene vs. Leptinotarsa Unigene= 2E-62
aaattctgcaaaaatatgattctgctgggatttacagtttctctacaaatgggacaatttttttgataactcaaactgtcataaatgcagttccaacaaaatatgtggccacaaggagtagaacatggtgactggagattctctgcacaaagtacacacgactttattgaaacacttgtatgaactacattctttgagtaatctcctttgtttttgaaaaggaagagtttacttatcaaactgaagagaatataaaatagagacacgttccctaaaaaatagaaagctccagtgaatgagtccttttggagccagtctctgagtaagacataatgtatccctgtaagcctgtttgatatgttatagtattttccatccatgtagaacagtgaagtatgtattctcttgatagtagacttctcttctttgaatatatcaatacagctcaggaatactgatttagctttatctgtcatgctaacggaattatttattttatttctggaatagttcaataatctttctaataatggttcccctcctacatacaatattaaccaaagagtttgtgcagtcttcgaaggtattttgcccatattaccgactcgtatagtaccagtatattcttctcctagggtttgcaaatttcctaaagttgtcatgaataataccataaatttgctagtaatggtacagacttattcagtgatggtaacttcttgaacccattagtttgaaaaatgaatgcatttgctcttccaaatcccttacaaaaagttcatctctttgcgatagccgcaagacgtctgccaccttggctttataaagagtcatttttgtacaatggggaatattccagtttcttgatatcaaaacaatataaaattgtagtctgacaacatatttaggttacatttgtctattgacttacaacgcttgtcagaaatatcactttcaataaaaaatagtatgaattttatattttctcaaaaaaaatatttgttatattcctaacattaaaataagtaaacatcaatcaagaaaaatgaagctaaagcgcc

SEQ ID NO: 434 - DNA, 1080 bp, Leptinotarsa decemlineata
  Annotation=Alkylated DNA repair protein alkB-like protein 1; Tribolium gene name from OrthoDB database=TC007602; Blast E- value Tribolium Gene vs. Leptinotarsa Unigene=1E-1; Blast E- value Tribolium Gene vs. Leptinotarsa ...
  ...Unigene=0; Blast E-value Tribolium Gene vs. Leptinotarsa Unigene=0
ttataacataatattcacacttactgaatattggattttcaatcgaattgctatcatacaacttgtctcacattaacattaattctagagtgttcaaggtattcaccgaagggtttccaatcgctttcatctactaaaaattgcatttcgttattgtcattttcccatgtacagtcgttattaattttccaaggtgtgatttcggtatgtattattttgggaacagcatggtaggccaacctggattctttactcattatgataatatctccacttctcaggaataatgatgttggtttttcttctagagtttttcctccaatcaagaaaatagcagtctgtccaaaacttaaagaaaataacggagcatttaaattattttcagaatgatcagtgtggccagataatgtggaattcatttgatagtagttcacaatagcagcttcagctacgaagtctgtatatcccaattgatttgcaatgtattcaatcatcttcttcaactcttcgggaaattgctctctttctgcttcattatagtgctttgtattccagttatgatggtaaccaagagttgtccacctaagactcatcaaaatatttcgatcatgctgtgctatttcccagaaatctgaattagcaataatcttgtccgaaccatcgatattcattttattaggtttctttgtatagtctttcagacatttaacggtccaatatctttgaccaacagaagtaaacgggtttttcacgaatattaagcctggatggttcacaatttggaatatttcccattctccaggtggtttcaatcccaataaatgacagtattctttggaatcaatgaaacatcgttcaatttttgagtcctttaacaattgtcctgatttattcatgtccagtacatcctctaaacttggtaatggtttttttgacttataatatttaaaacttcttttaaacataaataaactcaagcaaataactttacagaaaaaaagtgcatataaatctcaactgagttaacaatgataacttcaaaataaagataattattcaaatacctttgcttctaaactc

SEQ ID NO: 435 - DNA, 1014 bp, Leptinotarsa decemlineata
  Annotation=DDRGK domain-containing protein 1; Tribolium gene name from OrthoDB database=TC001171; Blast E-value Tribolium Gene vs. Leptinotarsa Unigene=3E-43
ctaattttattcagacagaataaaaaatatttacaattatttcaaataattttcattcaactgctgtgggatttaaatttatcaatttattactgttctcagctaaatcagcaatggaaactcgtcctctctgccttataaatttggcaactgtctccatttcttgcatagatacatatataaattttcctctatcatctatgactcctgtcaaaatatcatctttttgaagatcttttattctatcaatagctgcctgagtttttaatttaaaatgtgcagccaaatcttcaatgacgaccactttgtttgatttgatgaaagttaacaaattcttgaagcaggttttgcatatctcctgcatctccttcttcacatccttcttcctccacagagaaagcttctttcattttcagatattcctcatgttcacgcctttcctcttcttctttagctcttttctgctcctcttcaattcttttttcttcagctttctccctctcttcagctttttttctttcatcttcagctaattctgctttcctttttttctccgcacgtaaaagtccctctgcttccctggcagctttttttttcagcttttgcttctaatttggctcgttttttggcccctaccttactatcaggcagctcaatttcgtcattggcttcgttttcatcttctgattcctgaatatcttcttgtgccacattggctctcaatctaacacctctgtttcgagccatctgggcccttctaggagccccatctctaaccctttgtggtccaggtctagcccttggtggtacttcagcaactttatttttctttaaatatattgtcaagcctataatgaggacaaatattactgacgctaaagctactaagagaggtaaatccatattcccaaaaaatttgaattatctcaaaggatatgccaatgtatctatttagtatttattcatgaataaccattattattattattatacatcataacaataataacctcc

SEQ ID NO: 436 - DNA, 3691 bp, Leptinotarsa decemlineata
  misc_feature (44)..(44): n is a, c, g, or t
  Annotation=polycystin 1-like 2 isoform c; Tribolium gene name from OrthoDB database=TC012701; Blast E-value Tribolium Gene vs. Leptinotarsa Unigene=1E-8; Blast E-value Tribolium Gene vs. Leptinotarsa Unigene=0
ctaactctaaaatcaatctatcaagtgaattcattaaaactgantaattatatgacattttttctaattttttttctagtgttctccagtagtttattccataaaagtttgctccttatgtttacctctgttggagaagagaaccgttaacacttttttcctatcttcagaaactaccaaatcatccactagtgttgctttcccaggcttggcatggcttatgaaaaagaaatcgttctcctctgaatcttccctaaataaatttacaatcatcaatttgattaagttctcatcatctgcagtcagcttttggttcctcttcatgcttctcaggattgcaagggtgacgtataccatggcgttggttttatttttaggcagcgtcagacaatttgcatatctgtgaacgtcagcttttgggaacacccatttccgaacctcagaaccatcctcttcacccccacgaattctcgagttcctcagcttgaccccagcaacctctttatagtactggtactgttccttcaaataatcaaaaacgtcatatccttgtcctttagaataaaatacttgcgcctctgcataagaaatcgtgataatagctacatacaacgtgaggaaaaataacgaaattagcatgtagaagctgtagtaagattggtgcaagggagttttcagcgatgagaaatcgaaatcttgatggaaagacaacgacatgagaaggagagtaactgcggaatccagtaggtctttgaaatcgttagactgatccccgaaaaataccataccaacgagggtgaaaatgaaaatggttagcatgtggtaaagaaatatagaagcaataggtcccagggatgatgttagagttttctcggcgatctttatgatcagtaagaacttcaacagcttccacagcctcaaggtggctatgaacactagaaaagctgctagggaagtgagagctgtttctgcaaagaagaggtggaagtagttgacaaactcgttatgcttggccttctctattctttcgaggaaacgtttcaccaatatagttctttccatatacagaaacaggcacgccatgctgatcattattatgattatatccactatgtgccacagatctttgaatacgattttcttcttctttcgtactaatttgagaactagctttactgataaaatgattatcatgagaacgaagcagaataatagaattgttaataacaatccggttttttctttgacaaacagcagacgtgcagaattcacattgaatttcgttctgatgaatccactggtgcttatttcgaatttaatcacaatcgactggaaaagattactattggaattgtacaagaggaattctatgaaaagacatctagtgaatctgtcgatccatttgttgcgaaaaatatagttaaggttggtcagggaattcttcatagttcggcctaaagttgcaacgtagccaccaccgggataagtagcgaattttccaacataactgaagctgccagttactgtataagcattgtagttccacacctggtccattcttgaaaactcatcagaattttcgtcatacccccacgtttcgctgaaatcttcgtactcaggcccttcagaaaactcgtgaatgcattcttgagttacaaactccatcggtgaaactaccatacaactgacattagttgatctgagttgccgaagacgagctatgccaatatacttattgttgttatcaatggtcataccgggatctttgattacgtatttgccgtaccactgagaagattgcatggagaaaaccaatgtatttgtgatatattcctgaatttcttttcgatcaaaaagtgcatgtcctttcggtatcgtcctggaatgtattccaataatcagatcatgcgcttctcgattgctcaaaaaggtcatcggatttttatccttcaaaattaccgtgtataacagcataacgtatatagttatcatgatgagatcttccacaatttcgaaggtgctttccttgatatgagcccaatgtttctgttctctttttgttctcctaaggatgaaattataaacaatcgtgactaaattttccagtaaaaaaatgtaaatgaggagactgaccacagtcgacgtcaaccacaataaagcagttacatgtggtacccaaaatcctaaaatgagtaatgtcgtcatacaagcaataacgaggaaaatcaccaaaccccaacaaaatatatttatctggaatgaatattttccaagtagtccaactttctcaccgtatttttcttcttgatgaaatctgaaacaaactgaaaaaagatacaatgggcatatgtatgagaaacgttatagcaaatccacccaatgtagtccataataggtgcatgtgaaagccgtactccgaatactggcctacactgtcgctattctgcaattttggacagccgtataaaaacaaaattatagtgtatgtggtcatgaagattgacatcatgattgtgagtctcttggttcttgaaatagtaacttcatcgtcgtgaaatatattccacatgtggcatccgtgaagtgagaatttcctaaatgaaaatcttcgttttttctttacatatggtggactttctggtacagcagtgagaaaatgattttctttatcgcctatttcaaatcgatagttgatgttgaaccaccaatatttgttcatttgtaggtcgacaacttctatctcagagcaataccatgagggccgtaaacctaaagaatcgaaccaaatttccagtttttcaatctcccccaaatggagtttcgttgctagaaaaaaccaatcttcctgattatgttgcagaattcttttctctggatcgggaaagttcaaaacgtgctccttactctccgaattttttccatacaattttatcactatatttgatgtcgttccagctccagatttattcccagttttcacaatgaggaggtatccaaatcgatgagaactaggaatatcactcaagaagtaaatgcttttttcagagatcttccttgaagacagtgtgatgtagatcagcaggacacaataaagggaaaaagctaccgctacggaaatgaatatgatgaagtttgtctccagctcaagttcatgcattgtgtaagttgatttttcctctctgagatcattattccttatcttgccagacaaaactgaagagtggtaacagagacaatcgaaacgctcaaaagttgtacttgagtctgacccgcaggagaattcccaattccttattgacggttcccaatggtagcaggacatggtgtacactcggaacttgatttcctgatcctgttgatctgatgtcccgggtaaaacgcatagataatgccaaccatcatagtcgagttcatgcggaatgtaaagcgtgttatggttgtgggtgaccaattcggctttatctctgaattccttcggagtgggtttcacgaaaatattgaggctctcattcaatgccaattcttcaaactcaataatgtatccttgctttctgaagacatctatccgaaacattgtaatccgttcaaaatcataaatatccagaggcaaagtagaatttgtttgactgggcgttctgcttgtgtgtaatacagttgcagctagttttattctcaattgttttgatgatat

SEQ ID NO: 437 - DNA, 1434 bp, Leptinotarsa decemlineata
  Annotation=ATP-dependent 26S proteasome regulatory subunit; Tribolium gene name from OrthoDB database=TC007999; Blast E- value Tribolium Gene vs. Leptinotarsa Unigene=4E-145
ggttgatctcagtagccgtaagaacgcgttcgatgcactcaaaaggagcctggagatgacaaacaaacggaagaactcgttggagtataagatgatcccaatgcttcagaacacagcaaagtacatacgggaccaactggacgaggctgaaagagaggagtttttcaggctcaaaaagatccaggctttcaacaactaaagtcagtaagctgtttggctatggatcccaagccgatggacgatgaaatccgtatggacatcttcaagacaacattttattacgtgtagagcatgaggctactgtcctttctgcccactacttcggagtaggcctcctcaaagtcctcctgctttatgacatatctgctggctctgatagcaagcatgccggcttcctggcacaccgagttgatatctgcacagctgagcctatcggatcttttcacaatggcctccaggtcaacctctggatcaagactcatcttggccgtgatggctgtaaacaccaatctcttctgctttcgatctggaggggaaactcgatcttgcggtccaacctacctggtctcagcagagcagggtcaatggtatctgctctgtttgtggccatgataaccttcacatttgtgttctggtcaaagccatccatctggtttagcagctcaatcaggaccctctgcacctccctgtcggcagatgtcgaggcatcaaaccttttggttgctattgaatctacctcatctatgaatacaatagaaggcgccttttccttcgccagtctgaacacatccctgaccatcctaggcccctctcccagatacttctggatgaactccgagccatttactcttatgaatgtggagtttgtgtgatgtgccactgccttcacaagcatcgtcttccctgtccctggcgggccgtacagcagaacacctcttggagggtcaatcccaatggctttgtaaagctcaaattgcagtatcggaagctctacagtctccctgatctcctgcttctggacatctagcccgccaatgtcgctataggtaacatctggcttttcttctccgccaaccactggaatggaggagtcggcctctgggggcaacacatccacaatggcagaggagtgcctgtgtagtgccactgttgtgttgggaaccaacagctctctatcaacagtgcttagaatcttcaccacagagtttgggcctgctgtgctcgagacgatggctgtatttttgtcgattatttctagaaattggcccatgagcaatgggacagccttgacccggttgatctcctctttggctcgagcaagctcctttccaagaatgtctatctcttttctgaggtactcctctcggatcttcaggagcttaagcctttcctccttctgaaagcaggaaataaattcgcttgagctttccatcc

SEQ ID NO: 438 - DNA, 496 bp, Leptinotarsa decemlineata
  Annotation=N-acetyltransferase 9-like protein; Tribolium gene name from OrthoDB database=TC000126; Blast E-value Tribolium Gene vs. Leptinotarsa Unigene=1E-73
agtcttttattgtttgcatacagtgtaatatcgtaataggtcaatatgaggataaataagaataccacaattactggtaaaaacgtcatcttagttccttataggaaagagcatgttgaaaaatatcacgaatggatgaaatcagaagaactgcaacagttgactggttcagaaccactttccctccaagaagaatatgcaatgcaaaaatcatggcttatggatgaaaataaatgcacgttcatagttcttagtaagctcaaatatgaagagacaaaagatgaaatagcttcaatggtgggagacacaaacctttttttcgccaactgtgacgatcgactttgtgcagaagtggaaattatgattgcggaagagtgggccaggggacagaagtgtggttgggaagccacttcgctcatgctcatgtatgggatcacctacctgggagtgaaacaattcatcgtcaagatttcctacgtcaacgagatcagtatca

SEQ ID NO: 439 - DNA, 1496 bp, Leptinotarsa decemlineata
  Annotation=tRNA-dihydrouridine synthase, putative; Tribolium gene name from OrthoDB database=TC008984; Blast E-value Tribolium Gene vs. Leptinotarsa Unigene=3E-35
tgttatcattttatacaaaataataaaatccgcataacattcatatatctatgaaattcatcaaaataaaatttttccactatgacaccccagattccttgacaattattttatcttgtttagcatgtttctttgctatttcccttcttgtcttcactaatattctatgtccttcacaatctagatttcctaaataacatttgtccttgcaacatttttttgcataatctatatatgcatttggatcccaatggattaagacattttgtgcacttttccaaatttctctctggtaaatttggtggtttttcaggtcttctgcttatccttcgaagtttttcatttttttctacttatgatattgccctcagcattttcgaaatgtcttttattctccggtatcaatttatcttcattcagtttcttcttattttcttctacttttttaatgtgattttcgggggtgtctctaacatatgcctgacatagccaaggaggaagaattagattttgagtaccattttcagtagtttgttcccatgttttcaaaccttcatgaaaatgctcatacatgtccttgatttcagttgtgatttccctgaactgatgtaaagtattggctgcacctaacctgatccgcaaatggttatttgaagatattgttaacacatggtgaaataatttgaaaagatgacctctgacgtatgacaatggacaaggatattttatcaccaaatctaaatactcaaaggcaggtatccatgaagggggattatctcctttgaataatgcaggattatacaagtttccctctgctaccattactcctacagtgccagtgtcttctaaacatctttcaacatcttgaatacattggatattgccgttcgatataactggaatactcagagcctcccttactgccttaacataactccagtccgctaaaccagtgagaggtcctttttgttctcttgttctaccatgtacagtcaacattttacatccagcagattccaacattttagcatacctaactgttttttcaatactctcaaatcttcgaatcttgcaggtgacaggtacttttaaattactattcagggtacttacaattttttgcaataaaggccattcatcttgtagaaaagaaccatagtgtcctcttttagctatagcctgagggcaacctaaattaatatcaatagcgacacaatagtcctcagctaggagtgctgcttgaagcatgatttcaggatcatttccacaaaactgaactatcaagggtttatcttcttcacaagaagctaaggcttcttttctgtacttaggatcattgcagaatatactactatgtaacattggagtgtagcatagttgagcatcataccttcgactcaataatctccaaggtagttcactagcatctaccataggagcaactattctcacgggagagcctaacttgtttttccaaaattccatcttattttttc

SEQ ID NO: 440 - DNA, 1276 bp, Leptinotarsa decemlineata
  Annotation=Catsup protein; Tribolium gene name from OrthoDB database=TC013479; Blast E-value Tribolium Gene vs. Leptinotarsa Unigene=7E-1; Blast E-value Tribolium Gene vs. Leptinotarsa Unigene=05
ccaaaaaataaatatatttcaaaattgtctatatttcagtctgaattaaattacttattgaaaactcattcatattcagcgatcaccaccatcattcccactcctgctagcatagcagccacttgtagaaaagtttgaacaatactaggtttttcttcatcgagaagttcaggaatcacagatacaagagctatgtatataaatcctccagcagtgaaaggcaagatccaagacgccgccatggctcctgaactgttttgggcaagaagagataacgcagttcctgctacagctcctagagcagttgtaagttgaagaagcatggcattttttcttgaaacaccggactgaagtaaaatggcaaaatctccaatttcatgtggcacttcatgtaaaagtattgttatagttgtcacaattccaatagtattcccagctaaataggacgatccaatagctagtccgtcagtgaaattgtgactgaaatctgcagctaaattcaaatacccagcaaccttgatttctttgtcctccccttcaatctttttcttgcccttctcgcctttacttttaccattcttagtagtatcagccttttcctttgacgatttttcatgtgaatgaccgtgactgccttttataattctcacacatttttcaactaccaaaaaaaccactatgccagccaaaacccagagtccaacagacatatcatgtgcatgatcgccagattcgtgactgtgtgtatgggcatgagaatgactgtggtcactcacagccatagctgcatggggaattaagtgaagaaaggcatcacccagcaaacctcctgatgcaaaggccaacaaaatctttaacaaaggttggctactaactgtgttatccaggggaacacaaaagaggattaggaaaggggcagcacttattagcaaagttgatcccattgcatgtagccataattcttgagtggttaatgcaacctgtttttcttttaccggaacttccctatggtggtggtgtgaatctgaatttttatttgcttcttttgaatacttgtaggaaggcggttcatgagaatgtccctcatgagaatgttcatgggcagttaaactgcttgaacttattaaaaatagaatacataacagaatgaaacctttacacatgcttgctgtagaggtaatatctttttgtgtcagattcaggaagaatttatttttttaaaaatttgtttacgtgtttaaaatgaaaacatgaggaggttatatgaaatatgaat

SEQ ID NO: 441 - DNA, 582 bp, Leptinotarsa decemlineata
  Annotation=Ribosomal protein L20; Tribolium gene name from OrthoDB database=TC013079; Blast E-value Tribolium Gene vs. Leptinotarsa Unigene=4E-72
gtttagttacgtacttcaaatcaaacaagaatagaaaataggaaaacatttatctgcaactgaaagtataaaagtagacaatggtatttaccactgcagttaatttcataagatctcgaggcccagatgaaatttggcggaaacgtaggatttttaaattagctgctcattatgttggtagaaaacgaaattgttacagtatagcagtgagatatgttcaccgtgctttagtatatgcaacaaaagcccggaaactaaggaaagaagacatggctaatttatgggaaactagaatcatagcaggttgtgaacaacataacatcaaatatagtacatttcgggagagtcttgtaagaagtgatatactgctaaatagacaaactctggcaaacttggcttgttgggagccttacacattcaaagccttaaccgatatagctaaacgtagagctgtggatgatgggcttgctggggtcatcaaggaagattctcttgacggaataatcaccaaaggttcgttatatagaggaaagtaacctagccccaacaatgtttcgaattagtcctaataaattgttttta

SEQ ID NO: 442 - DNA, 447 bp, Leptinotarsa decemlineata
  Annotation=Ribosomal protein L28; Tribolium gene name from OrthoDB database=TC003255; Blast E-value Tribolium Gene vs. Leptinotarsa Unigene=4E-57
atcttacaaaatttatttattccttctttgccttggtctttttggcaggaaggggcttctgtgacctaagtactgcgcttgccctacgaagagcggccttagtaaggtctgtgcggtacttatttgctttcaaaagacgcttcaacttgtagagggatcgcctgggaccagatttcattgtcctcttgacagtgctttgtttgggtttgcgctgtttactggcttttttgtaaacaactgtgaaacccttcttgtcagctgcatctactatgcctacagattttttgtggatgattccattatatctataggaactgagatttgtcaagttattgggttccgtactgaatggtttggaaatgttccttttcttcaatagaaaggcgttattgtttcggataattccccaaactaaatgtgacgacattttggctcgcttaaccttac

SEQ ID NO: 443 - DNA, 1321 bp, Leptinotarsa decemlineata
  Annotation=Gamma-tubulin complex component 4; Tribolium gene name from OrthoDB database=TC009163; Blast E-value Tribolium Gene vs. Leptinotarsa Unigene=4E-167
cgtgtctctacaagggttggaatctcagaccttcaacaatattgaattccagagcactattgaggaatgccgggtcaagctcacgaagtacttgtggtccgtaatgctagatgaaggcagtttggtcgaacatttgcacctcctcagagattattacgccttgggcagaggggaactgtttcaacaattcattagagtggccgaagatcatctgaaagacaccacctcagactcgattgtgcagaagctgaacttcatattcctggaaactgccaggaaaatctacggggaaaacgacaaaacctatctcaagtttgagctaacttcaaattcagacgttacacgaacaaatccatggtctagactgcagatgaacttcgagatcaactggcctctgcatatagtttttcatccgaaagtgatggagttgtataataagctgttctgctatttattgagactgcgtaaaacacagatagacctccataaactttgggcagagcatgtttcaaacaagcagacaatagacagaagagtttggacccttcgacaaaaccttatgttcttggtgaataatcttcagtattacttgcaagtcgatgtgatagaggcccagttctctttgttgctgaaagccgtcgaaaacgctaacgaattcgaagatataatcaaggttcatcacgaattcatcactaatttattggcaaaaacgtttgtgtctacacctgatgaggaacatatttatgccaacaaacacagactctatcaagtgccagctgtccagtacgaaatacctagcagggtttacagcatcataataaggctgctcgaactctgcgacgaattctgtttggtggccagcacctggaattcggaattaaccgaacccgaattggaagagctcgaaatctttcaaaaaagaagcgacacagtgatagaatctctccttttcatactccacaggttgcacgagaaagttagcggacagcatttgttgcagttgctttctcagttagatttcaacaaatactttagtaaaaacaaggctgattttaactctaccacgttctaaattgcatattcatttttgaatagcactcatattaacttctgaacttgggtttagcgctggtaacacaagaagaagaaggatgactgcatttggtgtcagccggctgagagccctgacagccgtggccagtctaaataagcatgagtttaagcccaagggtagttgataataatcctcaatttgtaataaactgcgatattttcaatgaaaaacaataattggccattttaataaataatcacaattcca

SEQ ID NO: 444 - DNA, 724 bp, Leptinotarsa decemlineata
  Annotation=RRP15-like protein; Tribolium gene name from OrthoDB database=TC013294; Blast E-value Tribolium Gene vs. Leptinotarsa Unigene=3E-47
agttggttccttctcagatttcgtctcttttttagacgttcccagtgattcgtcaatattttgcgatttttctcccatgagcacatctagaaatgctcgcttgtcaatgtttttcatcactttttctttccttacttccaagggaccagcctccttgagtttttggttgatgtctttctgttgcatattcactatgttgaaaaagtgaacaacaccttttgttgctatcctctgcaataatctttctctgtctttttctaaaatgttgggcttcactcgaattttgggtaactcttttttcttttttctaggtggttctgcagatacagtgttatcttctacagtttctttttttacttcaccgtcaggtgtttgaatctcgaatcccgcaggttggacttttactttcttcagatcagtcaatttttttgccttagacaaaactggggtttttcctttcgttttcgttttcaaaactttcgatatagcatttgcccatccagcgtttccaactccatttgtgttgtcatcagattcttctgaggaattctggggtatttcgttctcttccgtgttagaatcttcatttgattgggaactttcattttcggaatctgatgattcagattggacgataacttttgcagctgtcatgattgcaatacgatcttgaatagtcttattatttcataatttccgaagacaagtaataaataaattaaac

SEQ ID NO: 445 - DNA, 1891 bp, Leptinotarsa decemlineata
  Annotation=Actin-related protein 8; Tribolium gene name from OrthoDB database=TC001452; Blast E-value Tribolium Gene vs. Leptinotarsa Unigene=0
attcatatttcgatatatattacaattataaatataaatgacatgaaaatgatagacactatcaaatgaaaataattacttcatcgtttctttcatctttaccaggtaaacggtgctctttctcgcaaaatcctaaccccaaatttttcccactcccccgcctgaatccacaactcgtgggcagtctccaaacaagaaagaatgcaagctcctttccaagccaccatcgaagaatccatgtccctcggattggtgacgatatcaagttgctcagctctatacagatacggtatttgaagcgatattctgttctggagccaagtcgctataccggaaaatttcataccccctccgacaactagaatacatccatacatcttccttttgatttcttcgtttggacacctgtcgatgctctgaagcacagcttgatccaagcctagaatctgcccgggatttgttacgaattcccgaacggatgtcatcacgacgggatccatagcatcgacaactatgtcgtcttcgttagcattatttggttggttgtctaagaagctgtcgttcagcaggtccgaagacgtagtatcaagactctccttcagtccagtcatacctttttttctaatatcacgcaaatagagctcgtcatgcggatcttccggatcgccgttcgacattttctggatgtgtatactcttcggtccagtaatgccgaacagttctgggctgaacaggctcaagggggccacaatgcattcatccccaacctgtatcgtgaaatgaaagacgggcttgccgggctgctttagaacgaagaacttctcctgggatccacacacgtccaagttgacatggcaaaaatcctccttcagcttccgtagaagcatcgtgtccagtttgttcttgtcgctgcattctttgtacggaaacgcacatttctggagaagccaaaaaaatatttgagttatgtcgccgcctccatagtcgagcctgactctggtgttttgatgacagattccatcttccacgcaagatactgacgttttctgatcccccacgtcgacaacacaagcgtaacttaatccggacccgaaagtcgcagctacgtgatcctgcacgaggaaacaacttccgaaccccattttggacaggagcaagtacatcaactctctcaagtacatccggttataaacatccggtataataagcacggctttgcactgcttcagatcgtctttactaatctggaagttcgtttccagcacctgaccccaaatcgcctcaaggtctgccatgatggccgttatagatccgccacctccagggtgcacgtttaagtcgccccgcttgtaaggaaagtgcacattaaagtcctcttcggggttcaagcgcagtatgtcattgccaacgaccacgtctccttctggctttatccattcgcccccattattgcccaacagctccggttgggaccttcggttgaacgctgcgatttgctgtgggggagtagcatatctcctcctaccgtccgactgcagacaggactgcagagtgtgcgaaacggccaacctggcttcttcgaactcctggggttggctcagatctattcgttcgggcaggaaagtgtccctgtagctttggccgtaaggcaatctacgtctcgctatggcatgtagcacggttaaagggttcaaatcggaggcgcgcccgattctaaggttcagagagccggggtgtattacgataatgctcttcgagtggacttgttcgggaggagtgtcgccgggggtcgtttgggacatcttcgggggattgtacgtttgtttgattggatctgcattaaattgaatttctgtagaagccgctatattaacctcaattattgacaatc

SEQ ID NO: 446 - DNA, 843 bp, Leptinotarsa decemlineata
  Annotation=Mitochondrial ribosomal protein S7; Tribolium gene name from OrthoDB database=TC006605; Blast E-value Tribolium Gene vs. Leptinotarsa Unigene=2E-112
gaggttaaagttaggtagtaaaataaaaaatgtttataagaattttttgattatactttgaataataaagcaaatattcaaaatggcatgcatgaacaaattcctcggaataattcagctatgcaaatcaaacacacaggtattgagttcacttcagttcaataaaatgtcccagtatcctagttattacatacagcctgtatacagaaaggatgttcaggaagaattgttcaaaagtggcgaagcacagaaattaatccaccatccaactaaagcggcaatgaatgatcaaactagctctttggcacatgatgatcttgttaatttatttattaattactgtatgaaacatggcaataaattactagcaagaactgttgttgaacagtccttagaaagtgtaaaaagacttcagctggaaaaataccataaggccaaaagcgaagaagacaaacaaaatattgaactcgatcccaaagtgatttttcacaaagcagtggagaactgcaaacccattcttcagttaacgcccatcaagaggggaggagtgaggtatcaggttccagtacccatcacagacagaagagctcagtttttatcaatgaaatggcttatagctgctgccaaggataaggagaaaccagttagatttcatttgcaattagctcgggagttgattgatgcctcaaatgacacaggaagggttgtgaaaaagaaacaagatctacatagacaatgtgaggcaaatagagcctacgcccattatagatggagttgaaatatttatattttcaatagtttcaacaaatgaatattaaaaatactacaataatttaaaaaaaa

SEQ ID NO: 447 - DNA, 756 bp, Leptinotarsa decemlineata
  Annotation=TFIIH basal transcription factor complex p34; Tribolium gene name from OrthoDB database=TC011739; Blast E- value Tribolium Gene vs. Leptinotarsa Unigene=2E-94
gtgcatttttaggttataataaggttataacgtaaacattctgaagaaaaaactaacaaaatgagtggtaatattgaaatacccgcagaagtacctcccgaaataacttcaactgacgaaacgagtttattggtgattattatggacactaatccgggccaaaaaatgcttcgagataatccgcatgtattaacccattgtgtggagtctgtgatagctttcgcaaactcgcacctcatgcagaaatctcaaaataaactcgccattatggcatgtcattctaaaacaagccgcttcattttccctggtcctggaaagtcttcagatgttaggcaagtggatgggcagtatgaagtcttcacaaatgtagaaaagacaacgaagcataatttagccgagctcatgaccaaggaacattcagcctccattacagaatctcttatagcaggtacaattgctatggctttgtgttatattgccaggctccaaagaacaaagccccccggtgcaaagctaaatagtcgcatattagttgtcacaggtagcggatgttcagcctctcagtatatgaattatatgaatgtattcttcactgctcaaaaattgaatgtagtgattgatgtatgtgcactggaccaacacctgagtttgttgcaacagggatgtgatatcaccaatggtttgtacctcaaggtcccccagttgcaagggctgctgcagtatttgctttgggtttttctgccagaacctcctgtt

SEQ ID NO: 448 - DNA, 1710 bp, Leptinotarsa decemlineata
  Annotation=Putative uncharacterized protein; Tribolium gene name from OrthoDB database=TC000181; Blast E-value Tribolium Gene vs. Leptinotarsa Unigene=5E-153
ccatatacatttaattattgttaaattaataagaaatataacaaaaaaaatgtgatataatacatatttcttaagtggagaagataaggtcaaatcacaaacttttggaagagttaaaattatagaaaaactattaaaaattatttttatttcttttcaataaatttaaaggcacttaatttattatttattgagaggtatagctctgattttctccttctgctctgtcaaggctctggattcatgaataaaaactacaaaatgtataccctgttgtttagcagctctaacaaatccatcgttagcagttacagtgactgcttgaatttgatcaccaaatgtaaaaataattagggacctctcttttatctttcccccaggtttcaattttttttcatcgctgtattgtactttttcgaatattttgtgggatttgtggtcattttctgtctgcctgaaatctgcatcatctggtagaactatgagtctgttaagaagttgatgggctctaactttttcactgggtcctccaacagtatcaacaatattcaaaaaattatcccttgctgtctcacagcaatataacgtttttccttcaaacactgcatctaatattggtttttgtggtctaagcctttcccattcagcttgctgctttaaaacaggaacatcaaaatcaagtaactcagcacttccatttgttactgaactacagtaggctaacatggctgaaacgtctagattgactttactaatgttactaatattctctgtagataaatctgcagtattagttggactttgtaacatataatcatcttgatcagattcatctgactctgaactgccatcaaaattgagaggagaatcacttaacctatctcctttaacagtaattccatacgattcaagcttggcagcaatatgactgcctattccatttgaaaacacaaaaactatcttcggagtttgaaataaacagggatagagctttgcacacttaacatactcttcagcttggtcaataatacttttaaccccataactaccatttcccaaacaaatctggctcaatgacttggggttcctagcaatgaccttaatccaggtgagtccattatcacttattatatccacatgtattttacggtcttccaaagtgaaaattttatttatgctctgacaggtttttacatcttttaaagtatctattagtgctgagaaatgtgtcagatttgagcactgcaagtgttctttcttgattgaattgtttttataggccttttttaaaaattttaattcttggccaatttttctgtataatttttgggaaccctcaatggctttgaaatcttcaataagttccaataatttatctccgaaattgatcttcatcagagctaactccttcagatccacattttcattgtttgctattttcatattcatttttgttcgctgatcatgaatctgaagtcgaaactggcactccattctatttttagagatacagaaactcaaaagtttaaattgaaagggtatatttttaggagagattacctaatttttgggaaacaaagtttttggctttctgcttcatcatcttgatacaaaaaatgtgggaatctcacacataaagaaagaaagcaatcaatttcataaattaactctatacaaagatgtgtagatcatccaaaaagaagtaacttt

SEQ ID NO: 449 - DNA, 1192 bp, Leptinotarsa decemlineata
  Annotation=Mediator of RNA polymerase II transcription subunit 8; Tribolium gene name from OrthoDB database=TC009839; Blast E- value Tribolium Gene vs. Leptinotarsa Unigene=1E-143
tggaaataagttttttaatttgattaagtgtgcatcttgttattataaaaaatccacatactaatacactaaatagatggtagggtgaaaaaagtattttcaagtatttacaattgattcacattggtttactgtgtgaaacctaaaaatggataaactggaaagtaatatgaataaataattaataaatataacttttgaatagctaatttcgagcataaggatgcatttgagcagcactttttatatttgttttgatagctgatggggctttgttcatagtcattgattgagtgtttgatggaacttgtccttggcctggtgggccccctggtcttcctggtggggctaccatcattccacctgaagtagggtttggttgtccatttggattgggtcccatcttgagacccttgcccatacctacagcagcaaccaagagatgggtatcggcaacacttgaattttgttgagcatttcccctagatgaagattcaacttcccattcttcccttgctttgctgacaatatcccatacgtgagagacaaccttttgatatgtggctatttgtttctgtgcattatcgtactgtagacctaatgctttagtttctaattgcatcattttagtttcagctagtggttccagttttgttctcagataatcaggtaccaaatcatgtgcgaatgttgtcactctatgttcagttatttgtgctagctgatcatccctctctggagataacatcagaggtagaactgttaaattcctcagcactggacacttgtcatgactcataactttggataatgaagtgagctgccctgatatcagtgcataattatctaaaaaagacggccaattcattgtttcatattcattctccaatttcatgatcattgaagcaatagactgtttcaaatcattaactctttggataatagaatctaaggccgattctaattgtttctcttccctttgctgcatgatgttttgatgtttgccgctttaccaattcgtatgaaaatataaaatgaaattttcaaatcaggaattattcaatttcttttatggtaacaacgaacaacattgaatacatcaattcagtgaaaatagtaccacaacataggcacggtatactatatatataagtatactatggcttaggtaacaattgttacctatgctgtc

SEQ ID NO: 450 - DNA, 2238 bp, Leptinotarsa decemlineata
  Annotation=Diaglycerol kinase, putative (Fragment); Tribolium gene name from OrthoDB database=TC006495; Blast E-value Tribolium Gene vs. Leptinotarsa Unigene=0
atttcacagcgttaatggaaggatatttagacaatgcttaatattcatttatctagtcctgattcctattcatatctggatatttatcctactaccaaaatcaatattttatgtattttattgataaattaaaaaaagttttttgatcaaatatgggcatagatttgcatttgacataacagaaaatctctttacataacagaaaataattcaataaatcatacagtacaactatacaggtaatcagaaatggagaaatgaataaaaaggatttcaataatgaaacatagacattttacaaacgacaagggaaaattattatataaaattcaacatcaataaatacaagtcagaaattacaaatgcaactgaacacatgtacaattccaattattatattagtccgatctgttttggttaatcaaaacaggacatctgttgacaaaagtaactttcaacttaccagcatgctgttcccaaggctctccatcgacttgcattggtgccttttgtttcaaacgtatctctacatttttagcttgaccaagtctaatggggcaagataagccaatttggagctgggccatgtggaacgaggaataaattcctaccacttctaagaccccatcgtggtaggactgattcagtcttgcattaccatcaccgctcattccccataggttaacaccagcaccccatgaagaaatgttcagaacaactattgattctagttcgggaagatcgatatgattaccatccagatacaagtccagtcgtttttcaagatttttacagtctgcagtaacaacttgctgggtaccaaagcataaatatagcatcttattgaagaccctgcttccataaacataaaaaatactgtctcttgtcttatggaaattcaatgcaacttgtgcatccacaccaatactgatataattatacataaagtatgttttattgggtaatttcaaccctagatgtctggttgaagtcacttcaactttccatctgtccagttctgaaactcttgcgtcttgtatactttccaagatttcatttatatgcaactctgaagaattctctttaccccatccaagtaccctagagagatcattgccagtaccaaggggaagaatagctaacagtggctcaggatcaaggtccaaattatgtgatgttgtcaaaacccacgaaatagttccatctcctcctgctacaagtactttgatttgttttggggccagcaagacacaccactgtaatgcggcagagggctttctttcactcaaatcaatcacttgaacgggattaaggtactttctgaattccgataaaactaaggctccatcagtattgccagattttttgttagcaataacaatcaaaggagtccatttcttccaacccggatcttttactcccctgagaagtaaatgcttattcaatgctccttttcgacgagctacttgtatgcaccatggaggaactatcatatttctataaggcccaaagtcgcaaatctgctctgtaccaacaagacactctgtatgaactgttttctgacaccaacaacattggtaatcaacaagaccaggctccattgaacagtcctctccgcatttttgacaaacagcccacaacggtaaattacctttaacccaatgatgaaggtgattctcactactactagtgataactttacattttagtgctaggttagcttttttcacacattcaggatctgcacaaactccacagcaatcacaatatactccaatgccattgagtagaagcgattcacaaattgaacaataccaagctttggatgtaatttttatgggagtccaattatgatttttagtggaatctcgaactggaacatttccctcactactcaattttttaaatataaaaaaactcagaaaacatacaagtactgcactgacgaaactcgtgaatccaaaaggaggaaaaagttctccgaatatccacattctaggtctaacatctactctgtgtttgctaaaaacagccatttcaacgggaaattttcatgtgaatgagttaggaatgtaggggtgaatctttctttagaaatcatgtctcctttcaaattatttcatgcatacactatgaaatgaattttctagtaatttgatttttattgtttatgtttagatttcacttttcaaattctcgaatgtcaaaaaactctaggcaggaaaatttattacactc

SEQ ID NO: 451 - DNA, 1887 bp, Leptinotarsa decemlineata
  Annotation=10G08; Tribolium gene name from OrthoDB database= TC007975; Blast E-value Tribolium Gene vs. Leptinotarsa Unigene= 5E-61
tgtctataccgacgatattaaacctagaagaactactgatcaaccatatcgatcagaataaaaaaattgtaggtacgaaaatcaccagactcacagctcccggggataactttggtagtgaaatactaaaaattgatttagttttgaatgacaagactgggaattcagaaaacttgagtgtaatagcaaaacttatacccgaattcgaattctatcaggagatattcaacatccagtggactttcaaaaacgagaggaacttttacgaaaaaattataccatgtttacaacaatttcaaaaagaacaaggagttcaagatgtgatcgatttgtttccgaaatattatggctcaaggtgtaatttagaggataaagatgcaaaagtagacggaaatgctgttctcattctggagaatttgaaaatcaaaggttatttcacggaaaatcgaaaaaccggtttcgacctgcctaccagcaaacttctactgagggacgtcgcaaaattccacgctgttccattagctcttaagctgaagcgcccccaaagcttcgatagttatgtaaaaccccacatggctgctttccagccagaacgtccaccgatgtcctctccggacatgaattcctttctattggaagttataagagattcagaagactactgccggtttgcaccccaagtggaaaaatccctttcgctttggggcaagcgaccaacaaccttcagagaaccctattccacgttgatccacaacgatttgtgggtgaacaacattatgctcagaaaagaaaacaacgaaacagttgcctgcaagtttgtcgactttcagttatacacctacgactctgttgtgattgatttgttcttctttctcttcaccagcgtgcgaagggacgtactcgaggaaaatttggacttcttaatcgaatactatcaccaggtatttgtcgaaactctcagtagctgtcactgcgatacttccccattttcgcaaaagctgtttctggaagaaatgtccgcgtgcgctgataggattttaggtctaacgcttttcatgtctactttcatcgtaatgggtctggaaggtggtttggatcgtcctgatccaacgaaaccaccaaacatggaaggagctaaaatatcagacgaaaataaagacaaaatttttttcatcttgcatgaatgcaaccgaaggggatggctgaatttttgattcactccatgaatttgaataggtattttcaagttatagaaaaaaattgtaaggtgactaaagtttcatgtaaccaacatgcgaaaattaaaaaacaattggctaaaatatatgtacagagatgaagcatcagcacataaacagtgctatcacttgaattttttgaacgagacttccaaagaaaaatgtttatacctttttttgtaatatgatgaaagcttccgtaacttcaatgttgacaaaagtttcaaaaaataagtcattttttcacttcaaaggcttttcattcatttcaatgttaatagtatactactatcattacgaaaatcttttttaaggtatatacaaaatatatttctattctcaattaaaacatttcatattacattctaatgttgccagatagttgcttgttacgtgcttcactctgataaaagtagtatcaaagttatcattggcagtgaacgtgaaactttaatttcaatgcttttaatttcaatagtcaatgctttctatatcaatgaaatctattcaagtattttgatgataatattttttatttgctgtaaaaatacttctgatcctacctcagtattgtctagaaatagtccgctagacatcatttctttccaattttcgtcctgaatatattagaagatatttactgttcaaa

SEQ ID NO: 452 - DNA, 734 bp, Leptinotarsa decemlineata
  Annotation=CG8675; Tribolium gene name from OrthoDB database= TC002245; Blast E-value Tribolium Gene vs. Leptinotarsa Unigene= 7E-65
cactaattttattctcaaacctaatatacatctctcaagacccatcagtgtcttctccgctctcctcttcttcttcatctaagaaatccaagtcatcgtcatcttcttctatcttcaaagatttcaatttatcaaacaaatcctttctgtcttcttctcctgcatcgattttgggttcctctcctttgtctttcttattcatatacctcagaaatgttcttctctttctttcaggtaaagattggagcagtgctttcaattcggcatctaatcttggctgttcatctttcggctgctcgacctgcacgatttctttgtcctgacagcatttcgtgcagcaccgcagattcttcccacactcactgcacatgacatggtaggcctttttgacagccttctgtccgcacttgacgcacgtctttggctgcgtcagtggcttgtacttcttgtacttgatcttccactcaataatctctttgcatctcatgcaaacatcgctcacttggatcgagttgatgagtttggtgcggttactagtgtcgtgaaggttgtttttaaacgcggaacggttctggtgcttctgaggcctcgtccttgacgcatttcctctctgagagctcatgtttctttgttctagaagacacacaattaagtacaattcgttttcagggaccaactatttcgatatggtacaaagctctgtcaaaatacatcggccatactggaaatcagtg

SEQ ID NO: 453 - DNA, 755 bp, Leptinotarsa decemlineata
  Annotation=Putative uncharacterized protein; Tribolium gene name from OrthoDB database=TC011237; Blast E-value Tribolium Gene vs. Leptinotarsa Unigene=7E-33
gcccaggacctttcccaccatgcagttgttcagaactcagttgatgaatcccagctgcctcacgaacttttgaacccgttttacaagaacccttccatagcagctgctctagcaaaagaatcttggtttggccacaaagaattcccggttcaccatcgtgaagccgaaaagattcccagagaagaaatctacaagataatttctcggttacactgagggacagaagatgaattatttatttttggagtgggtgatagtgagtgaatgtatttggtggctgtagagattgagcacctttgaatgaaattgatatcaacgatcttagtggcaaatatgaaagattacgaatttcatttgaaagttataaatatatgtcaactgaaatcattgaaaatatttgaaaacaaaagattcagctgaaagtgatcagtgattcagttaccaaaaaaataaactatcttatttcgatatgttgaaaccttacaacagaaatagttcaacctaacaattgattatcataagaatactgagaatattgatgtttcacaatgttctttcaataaaaaaatgttgagatcagtccgtgaagataatgacactatcagttgaatcgtattgaatcgtgaggtacttatttgatttaaatcatcatatgattttgaaattgtaccaatgaagtcgggtcgctatattgatcaaaataatttcatgtagtcattccaattgtacatattgccgttcttcgtgatgatttg

SEQ ID NO: 454 - DNA, 791 bp, Leptinotarsa decemlineata
  Annotation=Eukaryotic translation initiation factor 3 subunit K; Tribolium gene name from OrthoDB database=TC007178; Blast E- value Tribolium Gene vs. Leptinotarsa Unigene=6E-136
ttttttttttttttttttttggtttaaaaaaaatcaatttattcaatgacaagatgccataatagcaccaacactctcaaaatcaattttttcattgatattcttggttttgatgttttcatcttggttcgcgatgaaaattaaattgttgtcaatttctttccacccatatttttttacccataacttcaaaacgatatcatctacatctcctagaagctgagctagatgatttctttcgatagtctggtatgttattccaaccacatggcaaatgaatttccggatagaatcaacgaacccagcaattgattgagtgagctctggcaggctatgaatccttgtccagaaaacttgaaaatcacactgttccagaatgtcagccaagtagatgatttggttgatgggttcctttgataactgtttttcgtagaggagacatttgcacaaaatgaagtcagtgtgtggtaagttggttagcgccttcaaaagaatctgacaagtgatgtcaatattgaaactgtgtggattgaattggtataatttgagcacagctaaattggcttccaaatcataggaattttctctggattgaacttctacataccgctctaaggtgggtaagttgtcagggttatatctttctattcctttcagcattgttgcaacagtttgtttcattgcttctgccattttcagtttttgaagaagtgttatttgaggaattttcaacagattttctctgggcaagaaatgaatcctaattcttaatcctacacgtttgtacaacc

SEQ ID NO: 455 - DNA, 468 bp, Leptinotarsa decemlineata
  Annotation=Mitochondrial ribosomal protein, S23, putative; Tribolium gene name from OrthoDB database=TC005391; Blast E- value Tribolium Gene vs. Leptinotarsa Unigene=9E-47
ctcattataattgtcttactttgcactaatatacattatttgaaaatatttgctatagatatatcaactttcttttcctttgaatggtcagatagtgcatctttgaatgctgtgctcagactaacttggtccttatcttctgtttttccagttcgctctgatttcagaatctcaatagctgctttgtacatttgttcaggtgtcatatcaccatcatattgtttgtgaattttctgatgaatttcaagaaacttctgtgtcagtgattggtaattttcattaaagagatttgttgaacctaagttttgtttattattcctttgaaacatagctctgattttgtcttcctcataaaatattttctttagttttatatttggaacgactctgtcgaatttgggttcatctttaggaggaaaggcttcataaatatcataccataatggcctatcttcccagctaagagct

SEQ ID NO: 456 - DNA, 995 bp, Leptinotarsa decemlineata
  Annotation=Vacuolar-sorting protein SNF8; Tribolium gene name from OrthoDB database=TC007472; Blast E-value Tribolium Gene vs. Leptinotarsa Unigene=1E-95
atcgatccaagctagcccctggttcaccatatgttccagagcgttgcgacttctctccgtctcccagttcaagttcttctgcagataagacaccgataagcaagcctggttcttctcagcttgttgcagtatcgtcgaatggtccatgcttaattccccggcactgattgcaccatgtacttgtctttgcccatgggtatcacgttgaaaccgttgccaaagactttcaacttgcccgctgctcgtatcaggtcatctttcgtaatctcttggtgggatttgctctgccctctggctcgaataagtttcgttctcagttcgtcaagacctatgaggccaccatttttggcattcgtggctagacatacttcgacgatttgaactgccagctcgtagtaaaagtctccgatgccaagcacagaccagaatccctttccggacgataacgggtctacgcctatgctagcgcacatctcctggaactgtttcctaaactcggggttttttcggatctcgtttttgtgtttggaggcgaactcctctaaattcgttttgaaaacttccatttgcttggtcatttgttcgaactgcgattcctggatttcatttcctttgtccctgtatctttcttgttctagtttgttttttttaatggcccccaaaccgatgcctcttctcatgtttacagtttgagggtgctgttaatttcgtaaacaaattcctttgaataaggttaacaggttaggactttgacgtttcataatcttctttttttttgtgaatctggccttaacagtcggggctacgtcgccatgaaacattttaacatcttcctcttcttttttttttcaacttacggcataaggttatggtaccatgctgccaaccatgatatattttaacctcttcatctcttttaattttttgaacttgacaaataggatcatctagtaatataataaaataatgatgatgatagtcataatacatcaata

SEQ ID NO: 457 - DNA, 1415 bp, Leptinotarsa decemlineata
  Annotation=Solute carrier organic anion transporter family member 3A1; Tribolium gene name from OrthoDB database=TC004793; Blast E-value Tribolium Gene vs. Leptinotarsa Unigene=1E-28
gaggattgtcaaagtgttgccggacgggacggctggcaagtattcggcacagaattcgtattcggttatgctaatcaagtcggcagagagtcgcgcgtaggaccggcattgccgccggtgtttgggaagcaccgctgtaggagggtacgattgtggtgtttcggtcggtgtttatcgcgcaggcagcggagaaagtgatctgttctctgttcagttcactccgctcgctggtcaccccagacactttcgtctttctcggctgtctgttgtttgttgcgttcgtccgcgattcgaagtgtctgtgccccgtctacgactgactgccattgtttacagatgtctcctgtattgctgctgtgatattaatgtctcgatatccatcgctgtcgcttcgttctacccaccgcttcttcgtgcgataccctaatgcgatgttatcacacaaacgatcagacggtcggtgaatattcctgccgaggtaatcactaaaggacattcctccacatcacgtagtcaactcgacacatcacattcaaaggctgacgtagcaactagtaacaatgacgaccgaagaagagcatttagaaaatcacaggatgttggagaaatccagcaacaacaacgaattacctgaagaacgaacaatactcactcaacctacgcgtgactttcaacacaaaacagagtgcaatagaaaccttagggacgatgagagtgaaccacagtgcggtataggtccctgtacctcaaactggctgcagaggtttgcttcgaagcaagcattcctgtttgtgttttgcatcgcttgggtgcttcagggcatgtaccacacgtatttcgttagtgcaataaccaccatagaaaaactgtttcaaattcagtcgaaggtaaccggtattatcatgagtgccaccgaaatcggacaaataggatcttctttactattaacttattacgggggacacggccatagaccaaaatggatcgcgtttgggatgatccttttcgccgtatcatctttgacgtgctccttacctcatttcatatacggaatcgaagaaaatgaaatcagtgggatagctaatgacccaaatgtctgcaaaatcaacaacggaagcgatacctctatttttgttgaatgatgccgtagatattactagccaagggacgtcgaagactaatattgttctcgcgatattcttcatcagtttgcttggggtgggaatgggacagactgcagtctacaccttgggtattccctatatagacgataatgttgccagcaaggagtcaccaatttattttgctataaccattggcgtgaggattgtgggtccagcccttggcttcatagtgggttcactatgtaccagcgtttacgcagatctgtcggttgatccaaaaattgattcgac

SEQ ID NO: 458 - DNA, 700 bp, Leptinotarsa decemlineata
  Annotation=CG8027; Tribolium gene name from OrthoDB database= TC006039; Blast E-value Tribolium Gene vs. Leptinotarsa Unigene= 7E-22
gttactagatcttttgacattgacccataagaatccatagaatacaggaacataatccttgaaactcgatggaaacaagattgcaagattgcatgtagtgaaacactgacttatgtacaacataggccaaaaattgaaaaatgaacatgcaaaaaattaaattggcacttgttgctatttctaaaatacaatttatttgttatattatatcggaattcattgtattgctatcgacaacttattcaagaagtcaggggatgggatttttttaaaatagaaacacttataatggaagaaaaccatgaaaatcatttacctcatgttgcttcttacatcatccaaattgcgtacaacatcgcttacgttggaattgatcattgcaaaaaaaacattatttttttcagaatttggaactatactgtagttatattttggttttgttccgaatctttgtactaaaatttcagtcaatgagatacaacttttaactaagattttggatattgttggcaattttgaatctatgtatctttcaaatggaggtgtaggaacttcaggattgatgccattttgtgaacaattccttaacaattcttcaaagtgatcaatactggcataacttaatggcaactcatataattttgtgagcaacgttcttatttctctgtcagaccatgtgctggaatgatctgtgtcgaat

SEQ ID NO: 459 - DNA, 948 bp, Leptinotarsa decemlineata
  Annotation=Methylmalonic aciduria and homocystinuria type D protein; Tribolium gene name from OrthoDB database=TC000972; Blast E-value Tribolium Gene vs. Leptinotarsa Unigene=1E-93
ggctctagaataaaatgtcaaaaattaaacttatgtcaatttatcatgttaggtagattttcctttcagttattgagaaaaatttcaaacaaagaaattagaatttgtaattcatccaggagttattcaaggaaagtaggtagcaacagcaatggtccttacaaaattgtgaaacatgaacgacctgaaaccaaagataacagcaacttggtatggcgagatccaaatttcgaattactagcctcaaatggatttcctctattccttagaggaaacattggcatcgcctggtatgatagccaaacaacaatcaaaactcaccatgagttaatcatggaacagttggaagatgccgctgacataaacgatggaaacatgatgtgcagagttcaaatgtgtccgactgttttacgcgaaactgtcaaagatttgtttccatatcgaacattagaagatcattcagaattgtctgtggtgactataactctgaagccaaatgtcaaggacatgaggaaaaataaggaattggaaactgagagattagctcaattgtttctcatagctgcaaaaaatatttgcgacaagctgagagcatctggctattgggcagacttcataaatccctactctggtcgaccctactttactccatcttcattgggtgaattgtatcaaacggacgaaaagttcagatgtcttgatttccaaattattgaaataaaagattgtaaagttatatcaactgagagtaatgctcaaaagcagtttattggaagtttgtttactagtgccccttgcaaaaaaataactaaattcgatattcacataaggaaaatatgaatttgtgcagatataaataaatatctacatgttatttcagcagagctgttaaaattgaagaagtgaaacatgaactttttaaaaaattaaaaaaaaaaaaaaaaaaaa

SEQ ID NO: 460 - DNA, 1601 bp, Leptinotarsa decemlineata
  Annotation=PAF acetylhydrolase 45 kDa subunit; Tribolium gene name from OrthoDB database=TC015135; Blast E-value Tribolium Gene vs. Leptinotarsa Unigene=2E-125
ggaagttgcaggttaggttttaggttaaggttatgttctcgtttcacatatttgcatttgcattcacaaaaaataaattgaatatatttgaccagagaaagataacataaataaataaaataacatgacttccaatgagtatttgttaacttcctcagaagcatcccaacaattttccatttgtttgtgggattacaaaaccatgaatgttcagagatattacagaaatggaggtgtagtacatacaaagtgtttgggtatattaggacaagattatattttgactgctgaacaaggaaagccgcttttgcacgtttggcctttgaatagtcaggacttggctaaaaatatcaggctcatcttaccagaaccagcaacttgcatggatatttgtcctcgcagtgtctatttggcagttggaatccaacgaaaaatatatgtttggcacatgtcatctggaaagttattgtcacttcaggaagggagttatcagtcaataacttgcataaagttttcaagtgatggatatttcttattgataggagggaataatggatcactgatcacttataattttagcgaaatgataaggattaccaacaactttctctctcagtcagatattggacaagctgagccttgttatgagaaaaatgatcactccatgtcgattacagatatacatgttggtcagtttggcagaaaggctcgatttgctactgtatcacaagatggaacatgtttcatttacagtctgctaaaaggtgaactactgctgaacttggtgtttggagatcagttaactagtgtagtttttgacaatccatgtttgcagttgattgtaggcacagaacatggagatatcaaggcattttatttaaacaacccacccaaaactctgtcatatcatttcgatgaaaaatcaggagtattgttcaggggtcaccagaaaaagatagtgtgcatggctgttaatctttcccaaacagtcttagcttctggcagtgaagataatttcgtaatcacttgggatatgaagagcggaaagattctaaaaaaaattgagcataaaggtgttatcacaaacatcaagtttgtgatggctttcaagaatttttcgactgaaaccctcaagccacaaataattttgaaaaatttagaaagaattatagattcatcaagaaacttcacagtttctaaaattcaaactgaagatattgtatttagcgatgaggaaacctcatcaacaagttgtagcagcaacgacttgttgagagaaaatagggatttacgaattagtaatatgcagttgttccaggctgctatgaaaatagctagagaatatggttttaaaaatgtggacacttgatctgtgaagaacgtgtattttttaaaatgactgaagaatttctttttgtgactttcataggttttaaaatatgagttgaatcaatgaaaaattcattgaataatattaatatgttggaaaaatgtattgatgttgaagtaaatactgttacattatttttttcttctctggaattactttgtgacatatgaaattgaactcgtgcatctcataatctttcatgtatgaaact

SEQ ID NO: 461 - DNA, 1275 bp, Leptinotarsa decemlineata
  Annotation=Thioredoxin domain-containing protein 15; Tribolium gene name from OrthoDB database=TC005372; Blast E-value Tribolium Gene vs. Leptinotarsa Unigene=7E-112
taaactatttattctacagttcctttcataaatataaacaagattttgcagttgtaaaataggagaaaaagttgttctataatttatattacataagtacttaggttaaaattggcccgtttacatttttttttgtacgaatacaatacatagaatttgttctgatctgtttccatcaaggtattcgttaccaaaaataaaatatctttcccgggtcttccactctgatctgctccttcataacacagaaaaaagaaacatttattgttctcatctaatcgttgaagctacttttcaaactactagatggaaaaaatctatcataaataaaattaatataccttcacaacaataaattaactattctatatgttcatgctgtgcatgtgcctccgactccctccaattgctttggatactttcaatgatccactcccaccaccttgacttagtaaaatagtatcctccacacattatcacaaacaaccatgatattatcaggaaaatatcataatctttcacaggactagttttgacaggaccagcaaaatctgcagaggttacagtagatttttcagcagcagctataccagtgtgtctattgatgaactgagagaaaagttctaatgtatattccgaaccattatactttgcaacagatcgaccattatgaaataacatcagagtgggaactccaacaataccattttgagtattcaacatgtggaatatcttggcatttatagctaccattttgatatcgggaaaggctctgggaagagcattgaagtgtggagctgccaaagcagaaaatgggcagtattttttgtagaacagaacaacgacacacaatgatggaatttcccggtctgtaatattaacatttgactgtaaaagtttgaagagttctgtgtcatttgtgagttggacggcggagtcacccattcctgtgagacagtttacaaacttttgtgttttatttgcgctttctgctggtagctcatcttcgtttatagtactgttgggagaagtttcactaagattttcgacgatattcgtttcctgggaaaggttgacattttcagttacaagattttcttgacaaatcaggcagctcaccaatgaagctattaataaacaattaaaataaattgcttcagtgcccatcgctcacttaaacattcctatttaattttttattaaaatacgaaacgtttcaaaacaactgatatttttccaaatttcctttacttttttaaattgctgtcaaaatcc

SEQ ID NO: 462 - DNA, 1398 bp, Leptinotarsa decemlineata
  Annotation=DNA polymerase epsilon catalytic subunit A; Tribolium gene name from OrthoDB database=TC009600; Blast E- value Tribolium Gene vs. Leptinotarsa Unigene=0
ccataaacatatgatcaaaccccaacatatgtttgccttattcctaaccccagttaaaaaggctgtaattttagttgtggacactgttaagacaaacttgatgcccaatatgatgaatttatatcaagcagaaagattggcaaaattagaaaaaaatcctgatgatgaacttctaccacctgaagaaatatccattgaagttcgaatagaatctaatctaactcaagtttataaaatattacaaaaaactttacaagcatataaagacgagaaaaaaggacctacattattgggtgtccagtctgccatggaaatgcatgacttgcaaaataatattccaccctttgccgattttcctcaagtgcaaattcatgttcaggatattgacgatttatacaatgcattagactggcaaaaaattggtgctcgagcgattgtacgtcattatttgaacagcgagagagtactggaattgatggcagaacagtgtagatattttcacttacccattggaaatatgccttctgatcctgccgtctttggatctgatttgttttttgcccggcatctcatcaagcataatcatgttctctggtgctcatcaactgatagacccgatctaggaggaagtcaagaaaatgatgcaaggcttctagcagagaatcaggaggcctcatctgaagtttgcaatgagcctggctggtattccatggtttgtgttgagctagacattgacagcttggccatcaacactcttctccaatctcatcatgttacagacatagaagggatgtctaatatcacagcatttgatgcatcagcagttacatctgtagatgacatgatatctggaaaccaagcaataaccacttacgacgaatcagctagatgcgcggaggccttcaaaattttaagaactatggcagcttcttggatgagagatatatcattgtatcgaaacgtgttcgctgattttcaggttattcacttttacagatggctgcgttcgccaaaatctcttttgtatgatccagctttattgaggactctacaaaatttgatgaaaaaactgtttttgcaactcgtagcagaattcaaaagacttggctgtatgataatttatgcaaatttcaataaaattgttatctgttctaaacgaaagaaagtggaagatgcattaggcaatgttgaatttgttgttacttcaatacgcaacaaagaactatttcattctttggaaattacattcagtcagtgttgggagcatctagtgtggttggatttggcaaactttggaggaattaaaggaaggcaccagaaggcacacaaaacgaatctcaagaggaagattctcaaaacgaagatgaaggggatgaggtatgagaataatgagccaca

SEQ ID NO: 463 - DNA, 499 bp, Leptinotarsa decemlineata
  Annotation=Single-stranded DNA binding protein; Tribolium gene name from OrthoDB database=TC007832; Blast E-value Tribolium Gene vs. Leptinotarsa Unigene=6E-71
ggtctatagccgctcgcaccacattcaaactgagaccaagagaacagacaatttttgaaagactttcttcttcttctgccaagtcccaacaagaacccccaagaatagagaaaaccattaataacgttcagctcttagggagagtaggcgctgatccacaaagaaagggtacagatgatcaccctattgcagtattttctttagcaacccattcaaattacagatacgaatctggagaattcttgcaacgaaccgaatggcacagagttgtgtgttttaaaccagggcttcgcgaaacaatacttacttatttaagaaagggccaacgagtgcaggtttttggtagaataacttatggtgaaataaaaggtgaagatggcaaacctagaagtactacagctattgcagtagatgacgtaatattttttcaaactcagcaatgatgtttttagaataggtaatgatgattatgccactttttttattaaatatttgaata

SEQ ID NO: 464 - DNA, 951 bp, Leptinotarsa decemlineata
  Annotation=Mitochondrial inner membrane protease subunit; Tribolium gene name from OrthoDB database=TC007631; Blast E- value Tribolium Gene vs. Leptinotarsa Unigene=1E-51
actaaataaatacaaataaccaaatgtcgttcgaaaacgaatctagctattgaacgcattaggttttgttttttgagaaatattatcttttgaatatgtagtctaggattgtttctggtatttatataattttctgaattatcatttcatcagttaatagactcaacaaattgttactactcgtggtccatgtcatagtttctatattaatctatatgatccatatatacctgattatttgaaagtggaatataaaaaagtgaatatcaaaaagccttcaaaactttcatggaaatataagttactggacgtaaagttgtacctcaccaaatgtctgattaatttattgttcaattaaaatgatactgaagacttgtgtagaatcattgggctacttaataaagtacggctgcttgctacattgtacatttgaatatgttggaaacttggtcgtgtgctctggtccttccatggagcccacaatacattctgaggatattctggtcactgagcatatttcactactaaaaacaaactatcagaaagggtgacatagttatagctaaatgtcccaccaaccccaaacaatatatctgcaagagagttacagggcttcctggggataaaatgaggatcggatttgcatcattcaagacagttcctggtggtcatgtgtggttggaaggagataatataagtaattcctctgatagtagggtttatggaccagtgcctcaaggtctgatattaagtcgagcaatttgtaaagtgtggcccccaaaagaattttcagtattgatttaatccttgattgtgagtttttcatattgtatatatctcattaatctagagagttgggaagaaattaatagttttaggatatttgtgattttattgaagtttcatatcaaaactttgaaatttgttgtttttcttctgattcaataaaac

SEQ ID NO: 465 - DNA, 333 bp, Leptinotarsa decemlineata
  Annotation=39S ribosomal protein L41, mitochondrial; Tribolium gene name from OrthoDB database=TC008165; Blast E-value Tribolium Gene vs. Leptinotarsa Unigene=2E-51
caagaggtgtgagagaaataggctataaggttgatggaaaatttgtggaaattcctgagaaaataccacaattggttgtacctgatttaacaggattcaagctgaaaccttatgtatcatacagagccccggaggtaacgcagtctaaatttactgctgaagatctatttaatgttgtgtatgccccaaaaattgttaaagatttcaaagaaggcaagcttgatagcaatggacaaccactagaaccatctgaagatgagaaaatgactgcagaagaggcaaaaatcaaagcaaagcaaacaggaacagatatattttagatctgattcagaa

SEQ ID NO: 466 - DNA, 1187 bp, Leptinotarsa decemlineata
  Annotation=Elongation factor Ts, mitochondrial; Tribolium gene name from OrthoDB database=TC013107; Blast E-value Tribolium Gene vs. Leptinotarsa Unigene=3E-121
tttttgatatatattttgtcagttgtgaggttataaaataacctgtttttaatgtatcttagtttccgtagttaaaaaaaaaatagatttcaaaatgatactcaccaaagcgattacaaggtttttccacctaactagttacaattcagcagctgagaagtctttgcttgccacacttcgcaagaaaacaggatacacttttgcgaactgtaaaaaagcactggatatgcataacaacgatttgaatcaagctgagacttggctgaaacagcaagcacaatctcttggttggtcgaaagctacaaaactggagggcagacaaaccactcagggccttgtgggtgtagtagtgaaagagaatgatggagtattggtcgaggtgaactgtgagactgactttgtggcaaggaacagggagtttcagaaaattgtcgaagatgctgctagaacttgtttagattttgtcagaaatcatcagaagtcacaagataaaatcaccaaaatatgcctagatgcagaacaactgaaaaacttgaaggctgctgatggaaaattactggctgataagcttgccctggccattggtacccttggagaaaatgcaacattaaaaagagctttgtgcctaaaagctggaaatggcattcatctctcagcttatgcccacccatcaggaagtgctagtgataaagtcttacttggtagacttggaggtttattggcttataaagcagctgaatcaactgaaaatacgatagaactgggaaaaggaatttgtcaacatatagttggaatggatcccaagaaaattggaacaccaactgatgaacccgccaaaaacaaagatgaagaatcatgtctaattcaccaggaatatttgttagatgatagcattactgtgaaagatatccttgaagaacataaactggaaattatagatttcaagagatttgaatgtggagagaatatgaatgccataggagaccaaccattagagtatgttgaaacttgtcaatagtctggaatgtttaaccgctattattaatagaaaatacaattatgtcaataaataatatgaaaacataatcgaatttcacttctcaatacatttttgatgaatatatgacaataatttagaaaaatatcaatacattcagtttatgtttacttcgtcatgagcacatgtc

SEQ ID NO: 467 - DNA, 2464 bp, Leptinotarsa decemlineata
  Annotation=ARP6 actin-related protein 6-like protein; Tribolium gene name from OrthoDB database=TC008881; Blast E-value Tribolium Gene vs. Leptinotarsa Unigene=0
atacatatagttgaacatcttgaatagccgcatgtccaatataaaaaatgttcctttcccctctttaatgatcaacaagggctgtagggttcttgatattaagttttttcagaacctctggtgcgctctgaaactcgtgttttgagataaagtccggtttggccaacatagcattcaggaaagtttccataggaaactaataaggaacatttcattgattaaattttactttttttatgcaatatcttttattcaagaaaaaaacccgacgaaattcaacaaaaataatgaaaacatccgttgagtattagaaaaatcgttagtattcaaacttaaagtttgtgtttaccaatatttcaagagcaaaagaagaaactttttaaacggaaagtttcttctcttgccattaaaaaatctaatacaaaatttaagacgttcgaccaggcacgattatgaaaggtaaatccgaaagaaaacatttttccgaacatatttcaacatgaattatgactggttttctcatagtggtatctacaatgatatttcaaaacttagtatactgagttcatagttcaagtagattgtagaattcatatttttgaatatcttctgctggaataggtattccaaaatgttttttcaaggaactttctgacatttttaatttttccttcagttctagtgcaaagccagaaaaaaaaggttatttccctaacaaacttcatgaaaattataatttcattcactacacatacaaaacaacaaagcctcttgaagactataaatatgatccagtaccgaaaggaaatatatcaaccgagttcattaaatcatcactctcggatgagtccaagctcatgtattcgctccgactcttgtcatccctcagagccggctttttcagtctactgtctcgctcagacaagtgctccgaattgtctagcattgtttggtcgaaaccactaacttcgtcaatgatgccactgtctgcactctccccctccgcgttggggttcctattgtcatcagccacttgggaatcttctgctccttgttcctgcttcccaaaaatcgactttcccctgagtttgtcaaggtagcagtagacctgctcagctttcctaggttcttccttaggatccgcattgtccgtcatccacgtactgaacctctgctggattattgaggacccaagctcttcatattcctcttttgtcaccaggtatgaatcgaagtcgggaattttcagcaaggcctccccacccttccagctgtacgtgattggatcatccggttggtacacgacaacctcccaaaggtggggtagctgcgaccgcagctcttggtacattctttccctgaaccctgggaacttgcagttgccccctacaagaactatgttccttgctaggttctcctgatgctcctttgggcagagagatattgacttgacgacggcctcggcgatgcccatgcttttcatgccaatgtccgatgggtggaaaagtatttcgggcacgatgaatctttcgttgttgagcttcagtatctggcagctttcctctttctctttttgaaggaggtcgtttggatcttggacgtatcctctacggatgttgttgaaatccgggaggacgtagttcttcactatgctgttctctggttcgggtttggcggccagcctgagctcttctttgacgtccttcgccacgtaacaggtgtcctctttcacctggtttatcacaaacgtttcctccatgacattgtactgcctgtaggatatgatgtccttcaggtggttagtcaaaagtttcccacctacgttcatcctcctgattcctctgagatacttgttacctccaatgtaaggtatgacatgggtgaagctgaagcccgtatcaactatcacgcagggcgtatcctccgttagttggcgctcttttgcatacttcagcctcgccaagtcagttgggttcacgcggaacatcgatttcacttcgtactcctcaaaaaatatctcatccatgcaatcttggattgacttgaagttgaacagcggttgcgtcatgatgaccggcctctcgttcactgagtagacgtttctgctgaataagaagtcccagacgggcttctgcacgtcccattttgtgatatatcccctttcacagggcaggaggaagtatactccggagcagtctcgacagtcgtcgatttggttgcctatgaacagtctcttccgctctgatttggctttcatgatgcagttggggatgatcgttggaagaacgtcggtggacagtccggcttttatgctgtaggctccgctgtccactatgagagctaccaaggtattgtttttttggttggtttcgcttgtaccgatgctagagcgtcttttggttttggatcggtggtctgtcggtctagagtacatttttactgagctagagcagcttgtattcta

SEQ ID NO: 468 - DNA, 543 bp, Leptinotarsa decemlineata
  Annotation=Actin-related protein ARP2/3 complex subunit ARPC5; Tribolium gene name from OrthoDB database=TC013790; Blast E- value Tribolium Gene vs. Leptinotarsa Unigene=1E-65
cagcttagaaatagattaatttaatcgaaaaaatattttacactcttttggtatcagccagaactcttacaatgcacccgactccaccaacgttatatattttttcatgccagagcagtagttgtccactacttccttcggagggatattcaaagcctttatacacatatttcatcaagacatccaagtaatccatgttcagtgaatctataatttcatctatctgagaaggtttcactgccaggagaaccttgagtgccaaattgagggaactctccttaatttgttggttctttatgctcgttggagcacaattcaatactacttttaaagcatccaacatttttcctttttgaagaaatccattgacttcgttttcatctgctcctgccgaaactccggaatcagtctcatcttctttaaaattgtcttcggaatactgatcaacatcaatctttctgaatgccgaattagaagtatttttagccattttatgtaaaatgtatatttttgaattcaaataacttctaccctcgccctacc

SEQ ID NO: 469 - DNA, 519 bp, Leptinotarsa decemlineata
  Annotation=P21-activated kinase, pak; Tribolium gene name from OrthoDB database=TC008012; Blast E-value Tribolium Gene vs. Leptinotarsa Unigene=3E-1; Blast E-value Tribolium Gene vs. Leptinotarsa Unigene=06
gtattgacatatatgcaatgtttaccgtaagtacatctctatgagtaattcgtatgtttcgctcctcgcatcaggggaacgagcagagcaggagggcctgcctgtctcaagaagggatgcgctagcaattcttgggcagaagcacgctgagcggggtctctgacgagcatcttatccaaaaacgatagtaaacgaggcgatactttgtgagcgtttttcagtttcgggggaggcatttctcgaatccttctcatagcttggagggggggttcgttgaagaatggcggttctccgtccaccatctctattaccattataccaagtgaccaaatgtcaacctctggaccatacggcaatctggaaattacttctggggacatccaatagggggtaccaaccagagatttccgcttcggtagttcctgggacacctgagcacagaaaccaaaatcggataacttcaccctgccatccaaagccaacagaatcgaatcagattttatatccctgtgaatcact

SEQ ID NO: 470 - DNA, 4689 bp, Leptinotarsa decemlineata
  Annotation=CN-acetyltransferase UNQ2771/PRO7155-like protein; Tribolium gene name from OrthoDB database=TC010378; Blast E- value Tribolium Gene vs. Leptinotarsa Unigene=1E-1; Blast E- value Tribolium Gene vs. Leptinotarsa ...
  ...Unigene=0; Blast E-value Tribolium Gene vs. Leptinotarsa Unigene=0
cctatatattttgtacatatttttgatatattcaatataaataaaatcatatattatcaaacacagtgatttttcgttcattttataatatgaattataaaatgatcaagacaatacttgcaaaatatcttttggtaatggatcgatcctaaacctttggtatatgaaaaagtcataattaaaatttttgttttgcaacatacttgtttaatgaaatgaaaagtcaagtgaagtaaatgggatagtataccaagagtaacacctatgatgtttgatatccatcatgaaacttatgacgatattagtctgcaggactgcttcttctatatagcaaatgctgactttagatatctcatatgtattccatgagaatactatagtaacagctgataactatctgcatttatcagaaatgtaccctggtaaaataagcaaatctagcatgatgtgaaataaactttccaacacaaaaaattaattgttcttaatatataaattgtttcaaaaaatagtagaaacgactctggaaactcattctttcagcaacaaaagtatacatagaaatatttcacaatttacatagtatttttttatcacactaaccgtttcttgaataaaaataaaattctaattacatacacatcttaaatacaataatataaaaattaaattaatacattgaggtttgtacgggttgaaataaatttctcaataaaaattttctacaagaaagtgcagcagtgatatcctttattggttaaatgactagatatagttctacagaagaagaaaggtcggaattcatctttcaatgtcaattatggaacaaagaaataataaagagttgtgctttcaatgaacctttttcctgaagtacgaaaaatcactcactagcagcgctagtagttcggtagggacaaacactgcctaatgctcatataaacatatggtaaagtacaattaaaaaagattgttttcaacagaagatgttcctgtagcaaaactaaaatttgcaactgtaaaggataacaatgttgtaacattataacgttggcttgcatgccgtaatttaaaagtaactgaaaaaaaaagtgaatagacaggttagttagtatacagactctagtaaaagagtagcggtagattcaaattgtaatgaaagaaatttaaaataattatgaatttcagatttatttccgactgaaatatgaatcaaatatagatggtaggtaatgaaataaaatataatgaatgaatataatttaataaacgattgaggttgtatctcattctgatcaatgataatcaactatgaaaaatttactattcatttcacgttaagagcatacatatgaatatttatttattttctgcactgttatatccactctcctcgaagcatgtatccatttcttacatctaacctcattaatatgaggttttataaatggtataaaaaacacgatttcttcctcatatcgattatccgacgtacaatttgcaaaacagcaatgctttgttggcattatactagtacaaaatatttttttttatatcagatttatatttgaaaaaaataaattaatattacgtaaataacactgttttacatgtgaatagtttatgtttgtccctactattagtgctgtctctcttaacacgttcgctgtactattctcatgaagaaggttcattccatccacgttactttccaaaaaattgatatttttttcacgaattctaaataataggagtttctatagggggtaggataatttaatacccactttcaaaaatgtactatgaacaaaaccgtttggtgtttccagatcaaaaatgccttgaaacattgccaaaatatctcaaacgaaattcaatattctttcgattttttaatataacatttagtgattatgcaaaataagttacataggtatattaccaatagaatgaaatcaaattcagttcataagaaacacagaaaaagtgtaggtattgaattattcaagactgaaggggtgaaaacaaaatcatttctttaacgacgttggttgataaacctataaaaaaagttatttgcagttttgctttggcagacttacatactttgtccaaaaaatgtatataattactaaacatgatacttcatcaaatttaattcattttcatattattaggttgtaagaaatgatttgtcagttttaatgtcatgtgtttttgtagctccatatctcgataaatatttattatactgtgtattggtataaactgatcgacagagaattttgtactctttacattgatgttgttaattttttttacaaatttaaatttaaggcttctcttcggctttttactttatgatttcgttaagcggttttcagacaaaattgaaccaaagcgctgccgaagcagcaattttagtgttaatgaacgcactgtaagacgttggtttgcgaaatttcgttccggagattttagcatcgaagataatccccgaagtggtcgacctatagtaatacaggacgaggatttgaggacccttgtggagactgaaccatcacaaattgtacgcgggattgcggaagaactggatgtcagcttccatgcgctttttgatggtttaaacgatccacaaaaattgtcatgcctcgaggtctgttctcctttagttttgcgcaaccaaaactatcctttttgaatcagaccgtcacgtgtgataataaatggatcctctacgacaacaggagatgttcagaacaatggttggacgccgaagtgccatctaggcacttctcaaatgtcaaaaccagcagtcctattgtgcaataatcgacaaaataaaccgaatattgcgtcagcagcagccggcactggttaacagaagagatctgattctgctcacaacaacgtccatccgcacgtatcacaaatcaccgtccgaaaattaaacgaattgaacgtcttagttctgcctcacccatcatacttcctagacttctccccacccgtttatcatcttttcaagcacttcgataactttcccaccggctgaacttccggcaatcaggactaggcaataaaggccttcgttgacttcatcgaatcccgagcaaacaatttttatgctgacggaattgacttgcaaaagtgcaccgattcaaatggcccttatttcgattaaattgaataagtgttcaacgagatattacagtttaaagcagactcataaatatggacaaaacttttgaaacaacctaatagtcacctgcaatagaagacaaatggtcgaaattgatgatggtttttaatccggtagcacgtagcgttttatttttggtatccgccctgataattttttttaccaacttacttgatagatactttatcttacatctgtcacttatgcccgaggaaacttactatagagtgagtattttgcgaaaaaccttccaataaattgtattcagcaataccatctgctacttgatttggtggcaaaatattttaaagcaatttctacaacgctagttcatttttatccttgcaaatagcaatacttctgcggaaccacttttaattgaccccatgacatctagtctaatacgcataatactgataccataaaataggttcccaatcgaacagaacagtatcatatacctataattatataacaaaattttataatatcaataggtttgaataaatattccgtacaaaatcgaataacaaataatttttggcgactagttctaatttgtttagtaatcttggtgttgatcaccggtctcctctctccagatccagtgcagcattttgttcattttgaatactgcccaaggaaatatcgccactccgtttatcactttgccgcacatgaactttatataatcgaatatcgtccatggtgggtgtcctccattgatatataatacatacacaaatccgtctttacattttccattgatagaataatagtaaggtagaaaactatgtagcctaaattttttttgttcataaaatagtatggcagcagaattcgttgtgagaacatgtaaaaacacagctttgacacgcctcctttcatctgttaagagatgtttgagaaatgaatccagaagaagcgaggcaattccattcctccgatactctttcagcactcccagtgaaagtatatagccaatgtcataatcagatagagatttggcgagaataccccgatcttcctcatttaagtgggaatatgacttgattctagccactataaggccaattattcgctgattgtagactgcagccaatgaataaaacttactatttgttgaggtaatttgttcataccaatagaatgggtattcaattggaaaccaatcctggcataaccccctgacttcatccaaatcatctgggcacaaaaaccgtaactgtatatcagctagcgaatgcagtgaaatttgtttctcgttcaagataggatcttcctctgaacattttattttagctgggtaccaatttatatttgccattgatacccaaaacttcttaaatcgtccgattgaaattattctccttcttcattatcaaacagaaaaattttgacgactgataatattttgtcataattgttttcggtattaaatcctaatgttttctaattaccaactactgtcaaatgtcaaaataact

SEQ ID NO: 471 - DNA, 456 bp, Leptinotarsa decemlineata
  Annotation=Putative uncharacterized protein; Tribolium gene name from OrthoDB database=TC005463; Blast E-value Tribolium Gene vs. Leptinotarsa Unigene=4E-18
cgtgtctctattcagaaaatttaaatagatataactcaaaaacagaccgacatgaaaattgaaaggaatcattttataaacctaaaatgttaatttgtaataccaaatttcatcaaagtctaaaacggtaatgttaaattttcaagtgagtgtgttgatttggcatgtcacttaaatactttataaacatgattttgcatacacatttttggaaattccattgtatttgtagttcttgtgattatacaaaaagctcacctgaaatttttgaagagcatgtgcctcctcgcgctggcaagagtatgatgccgatgcatccgctgaaagggcgatatcgcttcacaccgcacatcctttttatatttttcatcagaaatcggtcttaggaaaatcccttcagaatccaaatatggtacgcaacccctgttccttattgatgtcaccatgactagttgc

SEQ ID NO: 472 - DNA, 1163 bp, Leptinotarsa decemlineata
  Annotation=Regulatory factor X domain-containing protein 2; Tribolium gene name from OrthoDB database=TC008959; Blast E- value Tribolium Gene vs. Leptinotarsa Unigene=5E-119
cagggacgctttgcgaacgcgtcttcttgacgctgggtttttgttccgactttggcgactgcatttttcttttcctttccttcccttcatttttttgttgaattttcctttgaagctgcagttgcatttccctatgcttactacaatttttgtaatttccttcctcacctttgagtgaagattcactgacagaagcaatttttgaggcagcttcagaacctgtgccaacagcgtggttcattatcaaatgataagctagagcttggatagaatcaaatttctgattcagctgctgttccgaccattctttcacaatcaaccatgctgcggatgttaaacttgtttgagtgaatggagcctccgttgacattggtttatctgctaaatctggaagtttgggtgtttttagcttcatacatcttctcaaaccagaataacaatatctggaatttcctctagtgcccaatctcctagcacgtacttttggatagacctgcttcattacttttccaaaatctgcttgtgacagtggtttgatcgtgtttgtcacacagtagttatgataatcattataaacctcttgctttggtagtgaagtgtctggatcttcttccaaatgagttttaatccatgatatcgtcctgtaaatttctgatcggctgcccaaaggattcaaagtttgcctgaaaggatctacagcatttgtgacttcacctggcaattttagaaacagcaggaatttttcaacctgagacagtggattaatcagttccagaatggtatgtattgtctgctttgcagtctcactaatggttaagctggttggaccagaatcaagatcgggttcacttttaacaaaattttcgtattccttctcgccggcttttttttgattcgccttcctctccttcgttttctgtgttgccattgtttaaatgatcctctgtcctttctaaacttgtcggcacagactgctgatatttcggagcccatatttcattttccattgtatttggacagtttttagtgagttttagttgtttttggcgtaaaccgcacgatattttaccacttttacagccagaaaggctagaccgcaccggaacattttattgtcaactcaaatcagctggtctccaatggacgacgatcatcctgcggtc

SEQ ID NO: 473 - DNA, 1469 bp, Leptinotarsa decemlineata
  Annotation=Zinc finger protein GLIS2-like protein; Tribolium gene name from OrthoDB database=TC030749; Blast E-value Tribolium Gene vs. Leptinotarsa Unigene=7E-55
gacattcatttgattgaaattgcgagaactcataacaaagttatattgtggttcagttttgaagaaaattgagaaaatgattgtttcacccttcaggatcgtaggacaacccctgcactatttcaacccttatccgaaactagaagtgccagacgatattcgctacatacaaaacttcgttccctaccacaccacaatggaaatgccaatggaaataatggcatcgtctccaataagtacacagagtgatagcgacaattccgtctccagcgtggaaatacctcagaaggaattaggaatcgtcaacaacataataaaatttgctgagaaatctcaggtgcagtgccgttggaaatcttgcggtatattttactcctctctggatcagctctcgtctcacatatcccaagtgcactcagctagtggtctaggcggactgttttattgtggatgggatggttgttccagaaataacaaaagttttaacgctagatacaaaatgctggttcatgtccgaacgcacaccaacgaaaagcctcataaatgtttccagtgcgacaaatctttctcgagagccgagaacctgaaaattcacactagatctcacagcggagagaaaccttacgcctgcactgttccgggctgcaacaaagcctactccaattctagtgatagattcaaacataccagaacccaccaagttgaaaagccataccagtgcaaagttccaggttgtcccaagaagtacacagatcccagcagcttgagaaagcacacgaagactttcaggcattttgtggttgagaaaacattagtagacgataatctacaaaactccgaagtaagaagaaatgaaatgatgtcaacacaaccgatttaccgagaaaatgttataagacatccatgcggttgtagcaaaggatgcagtgtcagcagttgcaatagtcataccgatattctaagaattgaagccctcatcaatatcagaaatgagaaaaaaagtctgagtacctggaacagatatatcgaaccttattttgatgagtgctcccgtgatttcagctactatgaagaaagcattcaagttgatgtgccattagatctgagtgtgcataggaaaaacttttgagtagccgattggtcgagatgttttcttggatataaaacttgtagcaagttcctaatggaaaatatcactaatgaaactagtgatacagaactggtacgatctagaatcaggaaggtcaatcattatgaataatgagactttttgtattgaaaaacccaaagtaaagggtataatttgattgaagtgtttacttaccagcaacagtgtggagtgattcttttcaatgaccagtaatgcaactgtgaaaatctttttgagcgttgaacctatagtaaaggtgttgagagtggagattaaatgatgtgatgttatgtatttgtaaaatataagtttgaattaa

SEQ ID NO: 474 - DNA, 2142 bp, Leptinotarsa decemlineata
  Annotation=Zinc finger protein 271; Tribolium gene name from OrthoDB database=TC010415; Blast E-value Tribolium Gene vs. Leptinotarsa Unigene=2E-48
aactatacactaaaattaacttgacatactatactgaaagcccacaattttttagttttctaagtattgaaaaattgaagtcaacggagaaaaatatttctctggtgaaaacacactagacactgacattaaaatagaagtaattgaagaaaagtttgtaaccagaaatgtctgaagagactgctataaaaaatgtttcaggatttgaggaagataaacacattaaagaggagaatatagagaccactccagtacaggagcagcataattttattactgatgatggggagccaaaaataactgtaaaagaggaaaattacgttgatgtcccagagcttttttcaataacttctgacttacctcaatttgaaactggtcaattcaaaatagaggatagtgaaaagtgtcaaagtatcagaattgagaattcatctgattttgaggaccctttgagttcctatatttttactcaaaatgaaaactgtattgaaaatattgatcaaggcttgtatgaagaaccaaagaatggttttcagtcgcaaggaaaagttcatacaggagaaaaactattttgttgtaattgttgctccaaaactttcacttattttggttttttgaagagacacaagaaattgcataagacggaaactttattcagttccacactgagttctaccagtttacttcaatctagtcttcaaacggtagaaaaatcccataaatgtaaagtctgttcaaaatatttttatgatagttctgccttatcaaagcactccagaattcatacagggaaaaaatctttcgaatgtgaaatctgttcaaaatcgtttttccgcaaagatgaattggtaactcatttcagaactcatacaaatgaaaaaccacacacatgtgaagtgtgcttaagatccttttctgcccgtagtgacctgaaaaagcattccagaattcatactggggaaaaaccatatgagtgcaagtattgctccaaatcatttactaacagtggtaacttgagaaagcataccagaattcacacaggagaaaatccacataaatgcgaagtgtgctcaaagactttttacaacaatgctaacttggtgaaacattccagaattcatacaggagaaaaaccatatgaatgcaaagtttgtttcaaatcttttactgaaaagcctacattggttgtacattcgagaattcatacgggagaaaaaccatataaatgtgaggtctgttcaaaatctttttcaggtagaagtaactttgcaacacacttcagaatccatacaggcgaaaaaccctatcaatgcactgtctgttcaaaatcttttcgttatggatctgttttggtgaagcattccaaaattcacacaaggcaaacacagcataaatgtgaaatatgttccaaatctttttcaaagagttctgctttggttaggcattcaaaaattcataaaagggaaaaactatataaatgcaaagactgttcagaatcgttttccagcaatgacgatttgatgaatcactctggagttcacgcaaaagataaaccacacaaatgtgaaatctgctcaaaatgtttttctatccgtagggatctggtgagacatggcagaattcatacaggtgaaaaaccttataaatgcaaaatttgctcaaaaatgtttgcaaacagtggttccatgtcaaagcattctagaattcacacaaaagacaaatttacacaaaagaaaaattcacacaagggaaaaagcgtttctgaaacacacaaagtcaaatttgaaagtgcattgaagtgaaaaagcatttctgaaacacacagtcaaatttgactcgaagctatttcagaaatctctaaaaatcaaccatgaataaaaatcatgacgactaattcaatgagggccaatctcgaaaactgctacttgaatcccgttcctaacctacaagcaattcttcttcatttttttatggtgtttgtttttcctacaggctattgatgacaaaaatgtattgggtgaatccaatggtatatttccaggtttgacgcagcagaacatcttattaaaggaaattacatttgagaatgtagattgtgcacttctcaaaattgaaactcgtgctataagttggatgaaatgg

SEQ ID NO: 475 - DNA, 492 bp, Leptinotarsa decemlineata
  Annotation=Putative uncharacterized protein; Tribolium gene name from OrthoDB database=TC013714; Blast E-value Tribolium Gene vs. Leptinotarsa Unigene=1E-18
cgtgtctctagaaaacaagtatttatttgttaattcagaacttttattagtccttatttcactatgtagggtaatataattatgtacacattattgacaaaacaagaaaacttctgtaaaatgataattcagttataaacacaatggaatgcatatgttctatacttaatgcttagccacgtctgaatctgtttccataacagctctgtcttcctgatccagtttcaactgttttcgaacttccctattggcatgcaataactgtaggagcttggcatgtatgtcatcattttttgctcaatatcatcaagagcagaattcaattcgtctaactgactatccaaattggcgaattcctcaggtgacatatcttcaatattttcattgtcagagttcatttcatgttcagtgttttcactttggtcactgttagatattccacttttgttgggagtaatcgattgctcacccatcttcatctatagaattaat

SEQ ID NO: 476 - DNA, 484 bp, Leptinotarsa decemlineata
  Annotation=Oxysterol-binding protein 1a; Tribolium gene name from OrthoDB database=TC014227; Blast E-value Tribolium Gene vs. Leptinotarsa Unigene=5E-61
gcagtccatatcgtagtagaattcgggatatctattgaatatgtggattcactcttaggaacagagttttctcccaagtcggaattggggtcatcaatactctctgacgttgaattacttttgaaggaagcaactttcaaactgttcagtttctgaagcatttttctggaagtgtgggatggggaatcgttcggacttttacttttcctgaagaaaattttgaattattttctttcagatattcctcatatgaattgtagtccgtacatttgatgaactccgtccattttccgtaaacgaaaatagtttttgtttcgacttatcggttataaagccttcaactctatgtaaatctttgctgtttccaccagcctgcttgaaagttaaatgagccttgtgtccggaagagtgactggttatttccatatttccaacttgttccatccacaactttcctacaataatgttgtgcacgcaacattgt

SEQ ID NO: 477 - DNA, 1097 bp, Leptinotarsa decemlineata
  Annotation=Protein roadkill; Tribolium gene name from OrthoDB database=TC000632; Blast E-value Tribolium Gene vs. Leptinotarsa Unigene=0
tctattctgttttattttcttttttgaacacattaaagcagtcaattcagtattcgttactgcggctttcacgaacttcagctctgcttgacgcgttttctcggcggacctattggggggatctgttgggtcgcgagagcacggaaagcctccgctatcaggtggggatgtgtctggatcatcgatttccaacccggagtgtccataacgtccgtggcgtgagtatttatgaaatctatggcctgagctttcagttgatcggcactgtggagatcagctaaaatgaggatttctgctgcattctctatcgataaatttgtacaaagtgcttcttcacacatcaccttcaacctttccagcgcatatttatctgctgctgctaataggtcgtcagccattttttctaaattcgacgcttttccggtataaatgaacctcagcatctctctcagtacttcatgatcgacatctgttatatctactcggttgtgtttcctttcctccatttcgtgttcgaacatcgcttggaaaacaggacttcgcgctgccaaaatagctttgtgagcttggaactccctacccgcaacagataatgtgacatcactgaacttctgattttcaaatagtaaacctaaatcgtccgataacctacattccggtaccttaaactgaattgtattcgactgacctgaaatatttacactatccgctacgacactaacttcacaaaatatagttaatttgtcatcaggaagtagaccgttggcctcgtctaataaaaagtctctcctaatgaactttttgaagccccagtctttgccctgtacgaatctgtaggccctctgactttccatcgcttttgtctcttcacgttttgcatttaatatactaaatttaaatttggctctaacttcactcttgttacacgacactaataacaaatataatgataggtagtctttgctttcttcgtctaaacctttcggattcactcgcaaacaccactttaatttatcattggcgccggcagaaaacgtcgaagactttaaaacttcgcccatttcttctcgacaaaaactaagttgttgatagttcca

SEQ ID NO: 478 - DNA, 897 bp, Leptinotarsa decemlineata
  Annotation=Protein OPI10 homolog; Tribolium gene name from OrthoDB database=TC004358; Blast E-value Tribolium Gene vs. Leptinotarsa Unigene=3E-115
gaagtttcaacgcctgaggtcgagtcgaagaacattacagaacaaacttaacacgaatattataataaaactttggttttaacaacagtcctcttaagtttctagaatggcaatgtttggtataatagtttctggacgattggttcaaacagaatttcagcaaattagtgaaacccagttggtaactactattaatgatgctgataacataaatcatatagtagtgtttctaacaggagttgtgccttttccagagggaatgggtggccaagtgtatttcagctggcctgatcctaatgcccctcctaattggcaacccttaggatttctttcgaatcaaaaaccttctgccatatttaggatatcaacattgaagaaactagatgaaatgggagattattcaaacatgatgtttggtcaaagtcatattgttcacaatgcccaaataggaatttcgatagagcccctctcaaatattcaagatgtcccttctcccaattccattgaagcaaatgttacttttgcccaaaaaatgttggaaaactttatgaactttgttttgagttatactattactcaatccaacatggtacctgatccaacagctacatacgtaccactatcaacggttcaaaattggtacagaaattttgagagaagactacaacagaacccaaatttctggaaatcgtaatttttattccatcaattttttgcaccatgaatttagattttaagcttttactgaaaatttcgtactctcagtttcatttgtatctaattggaaacattgaaaatgaagttaagagaacttatgttttaataaagtaacttcaaaatgctaatgtgttgatatgtgattttaattggaacatattgatttctccttcaaacttt

SEQ ID NO: 479 - DNA, 784 bp, Leptinotarsa decemlineata
  Annotation=ARP6 actin-related protein 6-like protein; Tribolium gene name from OrthoDB database=TC008881; Blast E-value Tribolium Gene vs. Leptinotarsa Unigene=1E-87
tgaactgatccaggtagcagtagttttcctcagctttcttaggttcttctctaggttctgagttatctgtcatccatgtactgaatctctgttggattatcaaagacccaagttcttcgtattcctccttcgtcacaaggtatgagttgaagttgggtactttcagcaaggattttccaccctcccaactatatgtgatgggatcttctggttggtatacgactacttcccaaagatgaggcagatgcgaccttagctctaggtacattctctccttgaatcctgggaagttacagtttcccccaacaagaactatgtttttaccaggttctcctgatgctcctttgggcacaggtatattgacttaaccactgactcggcaatgcccatgcatttcataccaatgtctgatgggtggaacagaatttcaggaacaatgaacctttcattgttgagcttcagtatttggcaaccctcctctttattcttttgcaggagatcattcgggtcctgaacgtagcctctgcggatattattgaaatcaggaagaacgtagtttttcactatactgttctctgagtcagatttagcagctagcttcaactcttctttgacatccttcgccacatagcaagtgtcctccttcacctggtttatcacaaacgtttcctccattacattatactgtctataggaaattatgtctttcaggtgattcgtcaaaagttttccacctacattcaatcttctgattcctctaaggtacttgttaccaccgatatat

SEQ ID NO: 480 - DNA, 966 bp, Leptinotarsa decemlineata
  Annotation=Pinocchio, isoform B; Tribolium gene name from OrthoDB database=TC006277; Blast E-value Tribolium Gene vs. Leptinotarsa Unigene=3E-33
gagtgcaatcgctcgttttccaacatatcagactgactgacatcgaacagttgcaagcgtagctaataacacaattcactcaaaggttgccagtgtgctgagaaaagagtttcccatttatccaatatcaattaacgtgctgtttctgttgaattagtggcttctgtcattgaagatttgtgagaataccaaaagaactcgattcttcaacaatgtctcttgccagcgtacaacgtccaaaactggttgtcagtttgagcaccagcgcgctgaatcttctcgacgagctgatccctccaaggtacttggatcataaagtggatcttgccccctcagaagaaatcccgaacgaattcaagagctgcttcagctgcggagtcacgtggtacgacgaccacgtgtcgctggactgctctgaatgcggtggctatgctttggagcgtccttgcccagaatgcgatggaaattgcggcgcgatgtgggaaagagatctccacaagtctcacgcttaccaaagatcctactggataggaaaatgccgaaatcgcagtcccaagaagaatccaacggaggctgaacagaaaaacaccgacgcctcggaaggactgagtatgagtatggataagctctctgtgaagaactcttgacgcttttttgccttctaaataatgtcagagttcaccaatatgtattcggccagaccacaattcttgaggatttttcactctcttctacatcacagggttcgattggagttgcaatagatgttttatattaaaaccggcaaacaattacgaaattagatgttgttatattttttgaactgtcgtttgtgaactgtggccaaaccgacaatatctcttcagctaaggtgttttcacttttttatagtaatttaaggaaactttttgtatttttcttgactgaaccgtatgtatacacctaataaattttcaatacaatgaa

SEQ ID NO: 481 - DNA, 1611 bp, Leptinotarsa decemlineata
  Annotation=CWF19-like protein 1; Tribolium gene name from OrthoDB database=TC009553; Blast E-value Tribolium Gene vs. Leptinotarsa Unigene=0
caaacattctttccattcagtcctattggaaacattcaggatcggtcctgaagcaagaatttctctagcaaaattcaaaggaaattgagtagacttttcaatctttgtatacatcaaagtaccatctggtagttcaacggtgaaatatggtgcttttggaggcagtacttgatctaaacgattatgattatcaagaatgtccaatctgaatccctggcattctgattcttctaaaaatatgtcttttaaattcttcatagcatttttcggtatgggaactgcctgaagttgcatgtgagaagttttgtagtttctttcaaaaaatactggaatttttccatctcggtcataaaacttgcgaagggaatccttgaatttctcaatttcttccaatacctctattggttgacctatgctactctggtagtgctctattggacatataagaaaatgttcttccacaagggcaccttttgcaagtgccaagtaagctgaagctccaactgaaataatgaggtgtttttccactgaggggcttgcaagacaaaaccaacatttactttgatcgaattcaattctgggtttcttattattttttttagtacttttacttgcattgtctgaggcattcatatcataaaaatactgactgggccctgaatatttccttttgctgttgaaaattttactttccaaatcatagaaattgaagggacaaagtgtctcgtctactgtcttctgtaatagttcactcagtttcattttgtctagtggtgtcagactcagtgcatatatccatttttgtttatttgcattactgacccttgccagtgctatgaatcgagaaacagtttccatggtaacatcatgatctcccaaattcggacatctgaaaggtggcctttcataaaatacgccttcgatgccactgataatgtacctcggtttgagtttcatacacagataactaggtagatcactggtggctttcactgataatgaaacctcttttgaatcctcggcaataatattagatggccactgagatgacagcaaaatatctacacctctgaacgaagggtttcctttgaggcacacatcacaaagttcagaaacttctttttcggaataagtccatggtccaacagagtcggtccctgataatccacttatataagctattttgagacccttgctgtctgtgtacaccccacgtttacctaaataataaacgttagggcacaattcaaactcagattcgtctgaaggatactctcttaaatgatcttccttatttggccccaaaatatatgtgataacgggaactttcttatcaccagttttataaggaatgaattccttattgttgattccaaaaaaatttccaacgcataacaacatgtcaaaaggtcctgatttttttacgatagcttcaattcgcttgaaaagagcatcaaattttccttccacatcaccacaaaccaaaattttctgtttatcagtcatttctctcaccaatagtacaaagttcttatctacaacattactgttataggtaccttcttcggacaataattttttaatattttatttttctgaataaaatgaaaa

SEQ ID NO: 482 - DNA, 1001 bp, Leptinotarsa decemlineata
  Annotation=Protein Dr1; Tribolium gene name from OrthoDB database=TC014716; Blast E-value Tribolium Gene vs. Leptinotarsa Unigene=6E-65
caattaatattatatgaaaatacaataaataaaaatataattatgtatatattcaagaaaaaagattacagttactatcttcatatttttcgaaattgaatgaaaacatgtgatacaaaaggaccatctaaatttaaatttttataaaaataagcattccaatacaactgtcaaaaatcacacatttccctcctacatcaaatattttgatattcgtatacttaaataaatactatacaaattattggtcaacacaattcaaatagctcacgtgagtctgttaccccaaaattttttacagctatccagatctcccaaatcactctctaactttatctacgaatactcgtcctgatcatcactgggaagtgtagagagctgtgcttgctgcgccgcggcctgaagctgttcccactgctgttggtcggcataagcctgctcttgtcgtgcttttgcaaacaactcctgttgttgtctcaggagctcctcttcaggtataccgagattttccaggcgggtgctttgcctccttcgtttagctgctacggctttgcaatctttgagaacagcttctgcttctgctgtataatcacaaaaacccaatctattcaaagccattaaaacatgttcagcattgatagtttttttatgaagttggttgcaaatttcatttgcctcagaactcagcaggtgtatgaattctgtacagcaattcaagatcaactctcgggcttcattagctattcttacagatggtaccaattcctttatcattttattgatacttgcacgaggaagagtcaactcatcatcttcagtattacccccgcccaaagcaccagcagaattggaattcgccatgaatgatcgtgaatatattaaaatttcaaaatgaggaagttgaggcttcaatattagtttatatattttcaattcaaaattatttctttttcacctatagtacagatgacatttatgtcacaagaagtttgactaatgac

SEQ ID NO: 483 - DNA, 1947 bp, Leptinotarsa decemlineata
  Annotation=Nucleolar GTP-binding protein 2; Tribolium gene name from OrthoDB database=TC014758; Blast E-value Tribolium Gene vs. Leptinotarsa Unigene=0
tctctgttgctcgtttctgcttacttgtcaactttttgtcacctgattgtttatgttgccttgtattctgttcaattgcttccattgataaatcctccacttcaaatttcccactggtacattcagcatatactttgcttttactttcactagtatccatatctgagtagaagctgatgtcagaatcagagtcatcttcatcctgttcagaatttgtgatacttttatctaagtccttattcgtttcactctcatccaaattggtactagtttctgatttgtcttctgaatattcaataacagctttctctatgtctttgataggttccagttctttaatgtcttcgccttcaaaagtaaacccaacatgaatctttctgaaatcttgaactacgctaagaggttcgtcttgtacagactccttggaattttgcaaaggttgttcatatccaggaggtgaacagtaaaatggtaatttgccccgctgccagtcattcaaaaccatctttgcgacactagtgatatctggttcaccctttttgagtagtttacctgacctttgagccatcttctccaaaaagtctatgtgatctttccaggaatctactttataagttttttcaatgtactgtggtttcactctttccaaaacagtagcaatataatcctcgggattgttcaccaattcaacacgcacaacgcctttcaaaactttttccacgtcagtttcagcagaaggatatactactccagggcaatcaattaggtaaattcttttcatgagagtgatatattgccacaccttagtttctcctgcaatcggagctactttacacaccttctttccttgaagagtattgattatagatgacttgcctacgtttggatatcctattaatccaactgatatttgttttttgtctatgtgcagtttaccaaattgtcgaaatagattgatgagggaaccttttccaaagggatgtgttatgctggcatggaaagccacagtcggatattccttactcaggatagcaacccatctctgagtcacccaacagggaacaagatctactttgtttagaatgaagatgaggtgtttatgaggtttctcagtcttcaaatatttttccaaataagacgatctagttcccatagggtctcttgcatctaatacttgtaataggacgtctgaactgtctactactttataaagttcattccatattcttcttgactgccctgctgccattacccaatctcgaggcatatcccgtactccaccatcatctttcacaatattggaatctttttcaaggctgtactcgtcagctttcttgtcagcgagctgtgtcaattcgtctaacccctttacaggtaaattgggcctttttctgatttttttgggtccaaaaacactgtcaaaactctcggtgtctagcaaatgaaccctggcatttttagccttttcattgagtaatgttatgggcagagttgtgggtttcatgatgacttggtaagggttttttattgcagctcccaactcagtttggaatttttgaagtgcattttgtgatataacgcgactattgccaaaccacttttgatttggttctaccctagctacagttccagaaggtagccagccctgaaatggggctggagtgaggatctttcctgttttgtctcttttggctttgaagtttctatacatctgcagccttttgatagttcccttacttcttactttgcctactcctttgagcccttctgtaggtctctcaggattcatagaatgatttgatttgttgaaaccctgcttacgagggggtcccgttgtagatctaactttaggcattttgttttattttatttatacgactgaatcaaatttatctgttggagcacgttagtgacttaatgacagaaaagctaggttatgtttgtata

SEQ ID NO: 484 - DNA, 1191 bp, Leptinotarsa decemlineata
  Annotation=Enoyl-CoA hydratase; Tribolium gene name from OrthoDB database=TC006554; Blast E-value Tribolium Gene vs. Leptinotarsa Unigene=2E-12; Blast E-value Tribolium Gene vs. Leptinotarsa Unigene=0
atattaaacgtaacctttgatctgttcgttgtatgctagcagttcgttcattatttttaacacaaaactattacatattcgacaactgtttctaccagaatgttgaactggccaacattgaatttgttgggtaaactggccaggaggtattcgcaaaatgcaaaagattacgaattagttgtggaatatttgaaaggtgatcatgtcgggattgcagtcattggaatgaatcggcccgaacagaaaaacgctcttagcattcgattgctagaagaccttaataaagcagttgataaattaatttttgaaaatgtagctcgcgtattagttctacggagtttcgttcctggatctttctgtgcaggagctgatttgaaagaaagggcggtaatgactcccaaagaagttcaaaatgctgtgagaaacatcaggagttttgtgaataaaatggtcaacgtcccttttcctgtgttaacagctttggatggggttgcattaggaggtggtttagaaatcgctttagctaccgacatcagggtcgctacaactaataccaaattgggactagtggaaacgaaattagccataatgcccggcgctggtggcacccaacttctaccaagactactcaatccctccgtggcaaaagaactaatatttactgcgaaaatcctcaatggaaagcaggcaaaagagcttggtttggtcaatcacgtggtcgagcaaaacaaaaatggtgatgccgcttacctgaagtcactggaaatcgccgaggaaattcttccgaacggacctttggggatcaagatggctaaacaggcgattaacaaaggagttgaagtggacttttccacgggactagctatcgaggaagcttgttattcacagctgattcctacgaaagataggacagagggcttggaggcgttcaaggaaaaaagaaggccggtgtatttgggccattaatgaacacattacttggtcttgttcactataactgagatgaattggatactaattcaacagtcagcaatactcaactcgaaaagttaattgttgtacaccttctgaaaacattttttcggaggtgcaataggacgatgtggttaactctcatattctcaatattcacgcaacactttttttattttcactaagaattatgcaactgtcgaataaatatttgtcttt

SEQ ID NO: 485 - DNA, 773 bp, Leptinotarsa decemlineata
  Annotation=Putative uncharacterized protein GLEAN_15661 87; Tribolium gene name from OrthoDB database=TC015661; Blast E- value Tribolium Gene vs. Leptinotarsa Unigene=1E-33
cttctatagttatgtctcttttttggatggactgggtctaaaatgcagctattagtatctacaacctccatcaaattgaagaatgattgcaaattatccaccgaccgatgaaattgctcataaacctctctcaaatttgaagaagctttgaggatatccttgtcttgtggcaagtcataatcagttatttggaaaatatctttattctcgtagtttaccgttatctcaacagagtgtgtcctgttttgatcatcttcagtggaaatgtttattttgctcaagtcacgtgctaaatgacattttttgaggttgacatagaatctggtgagttcataatactcgtgaagtacttgcttgtagatatcacagtgagtggatggttcgctagaaggaattttcgatttgatgtaaacagtaagagagtctaaatacgaaactatgctgttggtcgattgctgttgcataatattactaaacttcctcttcaaatgcttcagattatgtggtaaatggaggacaaaagttttttcagaaacttgctgtactgaaactttatagtcagtgttattaatttctatgaatccactgtaagttattgtgccatcttgaagagatttcgacatcaatggataattcaaaagcagttctatttcattctttatccacaggattgatgttcatcattgtgaaaagttcacatattcaaaacatcacaacagaaaagcagatttaatccactttgcaacttttattcaactcatattatactacaa

SEQ ID NO: 486 - DNA, 675 bp, Leptinotarsa decemlineata
  Annotation=DNA-directed RNA polymerase subunit E; Tribolium gene name from OrthoDB database=TC000127; Blast E-value Tribolium Gene vs. Leptinotarsa Unigene=5E-9; Blast E-value Tribolium Gene vs. Leptinotarsa Unigene=0
taacagagtcttattatcttaggtttgattatcccaccaggacaataatcctaggccatcttcgtttatactccccatcaaagcatatggggtcttgttttcggaagactcctgcgattcctgtacttgggggccagcaggacaagtttcattgaacatttccgcggtcactctgaacctaatcgaagcccctgcgtccatgaacaagtcgtgcttattatcatcccccatatcgtactccaaacccaagcctgctcattttcgtcgaacctggaaggatgctgtaaggctgtcgggggtatgaggatatcctcaaagaatcccatggtaacgtgcactcctacctggctacagctcctgatttttcctatcagaatttcctccacgaaaggcctgaagacgatgaatcggaattttactctggtatgggaagctccgtcaccagggaggatataggattcttgcagctcgattatgtcgaacagggctatgcaaaggcctacgtcaagaactaccttgttagccagtttcttgtttaattctccagcgatagcatcgtttaatttgaggttgaacagtccaggaggaattctcgttacgtttgtcatctctgctaagataaacattttgtattcttctatgcttttattttgaaaataaagttaatactaaagt

SEQ ID NO: 487 - DNA, 1294 bp, Leptinotarsa decemlineata
  Annotation=Serine protease P55; Tribolium gene name from OrthoDB database=TC013613; Blast E-value Tribolium Gene vs. Leptinotarsa Unigene=1E-51
tgaaatacagtcatatacaacaaaattaagtaatacgtcgttgttcagcgtttgaagttccctctgcaacgtctttctcattttacacgagacagtttcaaaataaactacttgatattttttctgatccagtcgatgaagctcgtaacccttgtgtaaactccaggataaccagattctgcgcacctaaacccataggataccactccaatttggtagtaacgtaaactatttccctcactgacagcgtacataaggggacctccagagtcaccctggcaggtgtctttagtggtattgtcaacgtaacctgcgcagatgattttgtcatcaatgaccccaatagtcccaaaagacctgacacaatgattccgattcactacaggaacctcaatgaattgcaaaattgagctcctgggtccatcaaagtatagagctccccatccagccactatcggaaaagttcctatgaaagaattggacttcaaaggctcttcatggggtaagcatatcggccatactctcgaactcgtatattttctttctagagtcaatatagcgatgtcattggtgcgctgaagtggactgaaattttcatggattttgaaaccaattacttttatgtcttctggttctgctccctcactgttactatagagatcaagttctcccaatcgaactaaatataaatccgttctgttatgaacacaatgtgccgctgttagaatgtgtctgtcactaatcaaagaacccccacaaagccattttggtacatttggattccatctatttctgtatcctagtgtaacgatgaaaggaaattgatcaagaacagctggcattccaccaactatcctgccatttttcacattactcaaaccacagtgaggtttactcagaagctgaggtaaaatatcatcatcacttgcttcgctttttctggaatcttcaggatttgtttcagtcgaaacttgtttattttcaattgcatttgtgttggatcgactgttttcattcaagtcagcagatttttttgagggcaacaaataactggaatgattccgataaaggaacatgttgcctttgtaatgtaagacattgtttctggattttggctctgactccgtagaagatttatcataatgtcacattttagaatgatggtacaagtaccttcttcctgtcttgatgtttgacatgatgacccttcaggtaaataggcataggcgaaagttattaaagatatagaataaagtaattttaacgtccacattgtgatatgatctcaagcact

SEQ ID NO: 488 - DNA, 1649 bp, Leptinotarsa decemlineata
  Annotation=Sister chromatid cohesion protein DCC1; Tribolium gene name from OrthoDB database=TC030592; Blast E-value Tribolium Gene vs. Leptinotarsa Unigene=7E-127
caataaaatatttcaataaacaaaaatttcaaattaattaaaaaaatatttattgccttaaaattattctttgatgtgtgtgtgtgtgtgtgcgtatttttttgatgtatttttttaattgaaactctcaaagtatattcaatcaattttagttatgatatttagagttatgaattatttttactcactataaacatatatatttcttgggaaacattcattatcattttttttgtcttgaaagtttgcttggtgcaaatgacaaaaaatgaaatatcgggatacatttttcaaatcttattttctatcagaaataatatcaaatgaatagtcagattatcttggtcttggtcacttcccgtgctttgaagagtagtactttattccatttactttcgaagctctcgcatatttggccaataaggcattcacatccagtttttctgttgtcagtcgccttatatagggtgctatttcaggcacactccacttttctttcacctcaaacaaacgtttaaacctttcgatgatgtcctcaggtaaagtgttctcatcaaaggccaccacaatattcgggttgatatttctgttgattatcgctattccataaagcatctcctctttaggaaccatcccttctggcactgaatctgtccatacctgcatgaactcctccaaactcagtttttcagtcccatgcaacagagctgaagcaaaaagtgcaaacttcatttctttgtacttgtagagctgcagggagtcgattaccttggattcttctgcgtatttatcaaataagccacaaactacttcgcggggaactaaatctgtcaatgattctacagtttcatcaaaatcaatctcatcaagctgccacgaattttcttcaatcagtttgaacatgtaagacaaaactcggaactggtacgaaaaatccagtaaccgaatttttccatcgagttcgataacgttcatcggattcaaagcttcccttagttctttgttagacgcttgtacaacattagctaattcttcgagagagaagagtttttctttatcaatctcgtgttcaaattctggtcctttgaaagtagtacaagaaaggaaattatttaattttttcaaatgaggcttccccactgtcgcttctagatagtcaaaaaatatagcgctcacagaaactttggacactttgtgttctgcagattcgtcaatatcattactcaatttcaaatcgttcaccagaagtaaactattagaagtttctgcctctgtaacatgaaaggtcgacgtttctgaacaaataacaacttcatcttcatcttcacctttgataaacaaagtgttgccagctgttatttcggaaagtaaatgtgaatcaagctgtagtaatttataatcgtgattattcaaatcctcatcagtgaaatgtaacatctgagaatagggtttcacatcgttcctgctgagttttgccaaagtcaatgtttcatcaattttatcaatgctaatcccttcctgtgaatccatatactcacgactgttgacaactatgatcaaaaactaatttctcaagggaaaaatataagttttatcaaagtattttcaaatattaaacataactgtcaaaaaattgggttaaggtcacc

SEQ ID NO: 489 - DNA, 1890 bp, Leptinotarsa decemlineata
  Annotation=Tyrosine 3-monooxygenase; Tribolium gene name from OrthoDB database=TC010480; Blast E-value Tribolium Gene vs. Leptinotarsa Unigene=5E-97
gacagttggaacgcggacgccgcatccgacgcttgtctagaaatttgttgagttttattcttcgcgtctcgagctatgaacggaaaagggatgaggaggaaaaagtcttctctttctgaagttaaagtggctgttattggtgctcctggggttggaaaaagtgcactgtcagtgagatttctaacaagaagatatataggagaatatgaccatcagtcagaaactaggtataaacacgaagtactggtggacaacgaacccgttctctacgagatattagacacatgtccaaagaatgaagatgatctccctcccgcagaaaccataaattgggcagatggcttgcttttggtctactcgatcatagacagacgttctatttcgtatctaagaagagtaggatcactcattgccgatttcgacattcctgtgtatatagttgccaacaaaaatgatatggtccaccttcgagaagtaagcgccgaggaaggcgccatcttggcgcgtcatttcgaatgcggtttctcagaagtcgcggcagcagagatggtggcgccagttgccgtcgtgtttcaagagctctgcaggtcggtgctggcggcccgcaggaaatcgaagcattccctgctggagagaatgctggggactagaactagtaatctccgactctacgctagagggaagagcgacagtgctttgccgaaggactgatgggtgtactgtgtgaaattttggatattttgttggcaattgatgttacttttcaaccaatatggcctatgtttgtgtgatatggttgtgcaaaaatgttttctactttcagtatatatttatcacaataatcactgaggcactttatgattgtcctcaattcaagcattgaataattattcgtttcatgtttaaatgaaacattcgataaattacttattgatatttcttattgggagaaatttaacaaaatcgtatgaaaatatttttcacaataatcaagagtttattcattctcaaatatagcaaaatttgtccaaaatatttttttgatagatgttcatatttatattggctaatatactattaaattaaatatctaatatatttgtaatattaaataaataatttggaggtgtcattgaagttttgtacggtaaagttagtttgctcattagtgagcagaatattcacaatgtacagaatagtaagtttggagtttgttatttttaattgttaataaaaaagtttgtggatatagttgaatataggaagaaggaaataacttttgtctgatgtctacttaatttccatttcaacattgaattatgaaaggaacacttttttctatgaacatggggaaatagaaagccagcaccttcctttcccaagaatgtatctcccctgaaaatatacccctttcaattcaaatcaggattccaactcacttcgatatccgaacatatttttattccgacttgttgcattttattatatttttagatgagatatacaaatcaggggcgatatatccatttctcgaatgaatgtctgatttcaaaaaaacctaatacaagttcatatcgtaaatcattgctgctcactattagataatttttatataataatgatcagatcaaaaaacgttcaatgtgccttctcatgtaaatatttgtagttagattgtattcgtgtatatttattttcagagatatagcgtacaaccttttgggtgaaggttgtaaacacatcaagatgcatggtattggcaatgccacttcaatccctaatactttcatcaaacacgtgtgaaatgttaattcgatctctaaaacaccttattttcagagtcatacggaattagcttctgaatgagcagtgtgcaaaatactgttgagt

SEQ ID NO: 490 - DNA, 1494 bp, Leptinotarsa decemlineata
  Annotation=Bystin; Tribolium gene name from OrthoDB database= TC013235; Blast E-value Tribolium Gene vs. Leptinotarsa Unigene= 0
catttccattaccttttcgtcttcctcattgatttctatattatcatagtaagtgctagattcgttttgacatcttttcaacattcagagatgctcaccagtaataaataacagcattgtctgttatttgtattttagataaagtttttgaaatactattctgtgcagtgcaaaatgggaaaagtaaaacttcccagacgaccaccactcgaagaggatattcaaccacctttgcctaaaactaaagagaaatcaaagctcaagtttgctatgaaacaggaggaagatgagaagttcgtcaattctaatttgtcgcgtaaaattctatctgaagctcgcaaacaacgaagagaacttgaaggaaatgatgatggcaataaagaaatacagataaaattcgaggaagattcggactctgatacggagacagttgatcaaaatgaatctagcacttactatgataatatagaaatcaatgaggaagacgaaaaggtaatggaaatgttcatgaaagagaacccacaacgttgcagaactttgggcgatataattatggaaaaatttacagaaaaagccaccgaagtgaactgtagtgaatctgggttggtacagatgcaagaccttgaccctagagttagggaactttatgagggtgttcgagatgttcttaaaaactataggagcggaaagttgccaaaggccttcaaaatcgtacctaacctcctaaactgggaacagattttgtatattactgatccaccgagttggtcagctgcagcaatgtaccaagcaacacgtattttcacttcgaatctgaaggagaaaatggcccagaggtttttcaatttggtgttgcttccaagaataagagatgacttggcagaatataagagactcaactgtcacctgtacatggctttgaggaaagctttattcaaaccaggaggattcatgaaaggcattatccttccactactggagagtggaaattgttccttgagggaggccatcattattgggtccgttgttgccaagaactctattcctatattacattcgtctgcggctatgctgagaatcgccgaaatggattacactggggcaaactcaatattcctgagaatattctttgagaaaaaatatgcccttccttacagggttgtagacgcatgtgtgtttcacttcctaagattcgaacgtgatcctcgtgagcttccagtgctgtggcatcaagctctcttaatgttcgttcaaagatacaaggcggacatttctagcgaacagagggatagcttattgaatcttcttaaacacaagagtcatcattcaataacgccggaagtgaggagagaactgcagaatgctaagtgtagggatatggaagattcttcatttgccatggattcaactgaatgaaccctagtgcagcaatatttgattgttgatgtttaataaataataaaaatctgaatataaagtaacatcctgtcactt

SEQ ID NO: 491 - DNA, 1245 bp, Leptinotarsa decemlineata
  Annotation=Tensin-1; Tribolium gene name from OrthoDB database= TC000706; Blast E-value Tribolium Gene vs. Leptinotarsa Unigene= 1E-86
tcatgatggatccctaccagcttacacgatatctacaaaaataatatcaaatcattcatgtaatatacaagaatcttatagaaatatttcttggaaaacagtatcaaaatcacaagtcctgcgctccggtacatagaataataaacaataggagaattccaacacttcttgagaagttcctggacccgaggtatcacaaggtacacaaatcgattgcgtctttataaaacgatagtgttacacaaataaatatcaacgactaggtcactacacgcaaaaagtatatcacgaccgaagaatatggaggttgattgagcaaatcttattgttgaaagaatgattctactcaacacacagcttttcattctcaaggcggacgcaaaccaaaataatacggcaagcagctcaattgaatatagcgaaacagctgcaatattattcactgctgagtagtagtttctgagtacatttgaatcttcccagatgtagacaggattggtggattgggttctggtttttcttgtcaatccttttttacatcagaagtggtttcagactcttcaataatgatccgtttggccagagtatgattggttgttttcaaagattcactgcgtcaacctccaataattcttttctttctagatgtgcaaattttggaactacacattcaagtcagccatcatttttctgaagtccactagggtgttgtagtcaggtgcaatgtcaacgtcagcaaagtctctttctgattccgattttacgaaattaggttgataacggctaagcgagagaggacagggaagtagctccggcattactgagtggtgtgtgatcagagaagtgagggaactgaattccttcgtgaagcccttgattttgtagcctttatttactcctagtattagataatgcgcaatgccagtgggttgaaaactcctcggtaccctcagagatagtgcgaaacatccaggtttcgttgtactatccctaaccataaacgctcccactggctctctcgacagtatctccaaagctatttccctaggtatacctgcttgaaaccaaccagcttggcggagttcttcgggttctatgttgttcagggagtcggttctctcaggtaagtttggggctccggtaaaaacttcccatgtggccttcaggagcagtaggttgtccagaactggaactgcttgagctgatttgcgaaatttcggttgcattgcaagtccttttcgtttt

SEQ ID NO: 492 - DNA, 841 bp, Leptinotarsa decemlineata
  Annotation=Eukaryotic initiation factor 4E; Tribolium gene name from OrthoDB database=TC012945; Blast E-value Tribolium Gene vs. Leptinotarsa Unigene=3E-12; Blast E-value Tribolium Gene vs. Leptinotarsa Unigene=0
agttttgaaaaaatttattacattaaaaaaagtaggacgtgtggctgtgataaactcattttattttatagaatatatataaattatataatatccatagtacaatacaaaaatgtcaaacaaatttgatacattaaaacaccatgtggataattccgacagtggaagtggcgatgaggattctggtccaaatatcactgacttaggacctattgaatatccacccggggaacaccgactacagcattcatattgtctctggttttcaaaaagaccatctcagatacaaggttcccagggttactcgcaagtcttacgattagtaggtcaaatagggacagtggaacagtggtgggccttatattctcatatggtgagattgcaagatattccttctcacagagatattcacctctttaagaagggtataaaaccgatgtgggaagatccagcaaataaaaaaggaggaaaatgggttataagactgaggaaggagcaggcaggaagggcgtgggaaaacttgtgcctagctatgttaggggaacagtttatgatgacaggtaacgaaatatgtggtgtggtaatttcaacacggtatcatcaagagtatgttctgagtatttggaatcgaacagcatcagatcaagtaaccaatggtcgaatcagagatgctttgaaaagattattgaatataccaccaagtgccaccatggagtacaaacacataatgattgccttaaatatggggcttcaaaggttataccaaataacgcattgaaaagttgactacactgagctatttcgaaatatgtgttaatgtgttctgttaattaaattttgt

SEQ ID NO: 493 - DNA, 1272 bp, Leptinotarsa decemlineata
  Annotation=Out at first protein; Tribolium gene name from OrthoDB database=TC008462; Blast E-value Tribolium Gene vs. Leptinotarsa Unigene=7E-52
tttacttattactgaattaatgtatttacttaaaagtaggtacgaattacattaagttagttctcacagatagtcaatacaaaatatgtaaaactcattctgattctaaatctagtctctctattttcaaactcattatatcaaaagctttttcttcaaaaccctgatttccctattttcaactgcatctgcaacatccacttgagtaatgtccacacattcaacccgaataagaaaatcaaatcatttacaataattactctatagcactaaggcagattggtccatcttttgaagcgaatttaaggcaagaatgcaaatctgtacaagttccgtttactaaggtcattcgtcccagagacactgttgcttttgcgacacatagtacgcgaataggtggcatattttgcaggtttttatgccgcacctgtagctcatgaccgagtttctcgattgacctttccccttgcagtattttagaccgcaggggtaccagcctatgcacaactctaggtgacactcacaaggcgtccacatgtttttcatttctgtacattttgctagggaggagttatccacttcgatgttgttcgagaagcgatgagaggagctgggaaatttcttcagagctggtttgtatgaagtcaccggtatatcttgtgaagccgcccacttctcgacatcttcgtgtagtgtgtacgttgccaaacctgcctctgcacacaggtcagaaatatgcggcgaaatgatcccagcatgtttcaggactaccacgtaggtcatagtatggttcaacctaccgagatcctcttcaggtaaccggatagcactgggatttttttgtcgtaatttagccatagcgtcagaggaaatgaaagagtctttggaaaaatggaatatgaagcacatcacttggtactgactttgacctcgctcctcttcacccaagacaagagatttaagcacttgtacttcatttctgaagtcaattagttgagtgacgagcgttccatccgacctctgaaattccaacgtgacggtgtcatcgctgacgttggccgatatgttctcctggacgacgtctccgccctgatttctgacgtttatcaccagttgagtgtccgtaaaattcactaacactaacaaacagaacactagaaagtttttgaaatgaaaacagttcattttaaaatacatattcgttgtattttggaccgagctgacagttctttcaacactccaccatttcggtgaaggaacaatcacacaatg

SEQ ID NO: 494 - DNA, 1798 bp, Leptinotarsa decemlineata
  Annotation=Heat shock protein 70 HSP70 interacting protein; Tribolium gene name from OrthoDB database=TC004720; Blast E- value Tribolium Gene vs. Leptinotarsa Unigene=2E-19
gaatgaatctattcgaaaaatatcaataagaaaatcttataggagagtgcaatcattcacatgtaactaatataactattggaactataattcatattttttcctcaatttgtcaatttcatcattttctcgttcactattttgcttcatataatcaaagagtttccataaattgtttctatcctcggaggccataaacattgtgatagcactgaaacgttttacttctgagaaataattcaaaatatcaaaaacgggatccttattaattatgtagtaattcaccatcacttccaagatattactaaaaatatcactttccagcgagttcaaaaatatttttggtaattcttgtggcttaacggactttaaataaatatacttttcttctgacgtcttgagattcctccaagatgaataaaactgtacagaatttttaggtgtagctaagttgacatctctatcattgcactctattaattttttattatcatttactgtattttttacatcctttgtacttgatgccgaataggttctttctgtaatcttgaaatcctcatttttaaagcaagtttgagtctcctgtttgaaatcaaccgtacttttggattgttcagacttctccaaatgtttttcagcctttttctttttgaattcgccaattggttcatcaagttcattcaaattttcaatgttttcatgcctttctaccacatgcctttttactgcttcctgagatttaggagattcaattgtcttttctgtaaagcctcctttcgtttcagtaattgatattctcttaaggggtttttgtgatctcagatgtgggggcttctgaattggcttgactaaaataatatcttcttgtggcgaccaagatgtactaggtttactgtcatctattggttttatgtctcgagttactctagaatcttcatttagagtttcatatatagtttttttgttaattttgttcctggatgctgtgaatttggaaacaggcctttggtccaatggcttttctgtgtgtctgttcaatttctgacgaattttttctaattctattatggattctttatttttaggttctagctctaggactttcaaaagatccatttcagcgttttctagtttgtttaaatttgacctagcagcagcacgtctttggtaagccttcacgtaagtgggatctaatttcaaagagagcgtacaatctttctcagtttcctcaaatttactgatctttaagtaacacaatgctctgtttgcataaaagactggatcataagaatagcattcaatggctttagtatacgatttgatagcctcatcccacttttggtttttcacaaacttattgcccttttctttttcaataagtgcttcatcatatatgttctcattacattcatctgtcagttccgaatcttcatttatatcttcctcaagtttttgtagttcagcgtcaacatcaaatttatcccaagcagcataattagtagttccacttttggtaagcttctttggttttccaataactttcaccttcgttgaaccagcttttgaaattttcctcactttaccagttgactgcccagtatctgtttttagagaatcatctttgcgtttcatttcttcaccccaatttttcaggtctttagaaaaatcttgtagatcagatgcgttttctctgagtattttttgtaataatattggatttacactcattttttaaaagtagataattaataattgtttactattgtaacactctttctcatgatccgtgaccacc

SEQ ID NO: 495 - DNA, 914 bp, Leptinotarsa decemlineata
  Annotation=tRNA (Guanine-N(7)-)-methyltransferase; Tribolium gene name from OrthoDB database=TC012665; Blast E-value Tribolium Gene vs. Leptinotarsa Unigene=1E-147
gtaaataacctcactaatttgaaactaactgtgtttatggaattaattaataaaatggaaaatttggcatctgaatccgttttgactgaatctatgtcgacaatgtctttaccgcagaaaaggttttacagacaaagagctcactccaaccctatagcagatcactgtttcgattaccctcagaccccagagctcatggactggagtaaatattaccctgaaaagttcagtcagaatccggcaagtcctccacaggttgaatttgccgatattggatgtggttatgggggactgctcattacattatccccgatgtttccagaaactctcatgttggggattgagatcagggtaaaagtttcagattacgtaatggacagaatcgcggctttacgatctcaaaatcccggacagtatcagaatatcgcttgtttgaggtcaaacgccatgaaatatttgccaaattatttcaaaaaaggacagttgaaaaagattttctttctatatccagacccccatttcaagaaggcaaagcataagtggagaatagtcagtcagaatttactggctgagtatgcatacgttctagacgaagggggtgttgtttacacagtaacagatgtaaaagatttacacgagtggatggtgaagcatttcgaaaaacacccactgttcgtcagaatttccgatgaagaactgaaacaggatcctatagttgagaaactgtacagcagttccgaggagggccagaaagtcactagaaataatggagacaaatttttagctgtgttcaggagaataaaggatcctttttttgacaaataataaatttgtcatcattttatattttccaagaccatttggaatacgaatgattgttatttatatttttaatgttaataaacataacatga

SEQ ID NO: 496 - DNA, 2384 bp, Leptinotarsa decemlineata
  Annotation=Kinesin heavy chain; Tribolium gene name from OrthoDB database=TC008919; Blast E-value Tribolium Gene vs. Leptinotarsa Unigene=0
ccctcaccacaggcgttaactttatatcatttaaaagaaggcaaaaccactattgggactgacgagtcggacgtcaaactaggacattgaactacgaggcgctgggatggagccccagcattgcaccatatccttcgaaaatggcgtcgcgactctgattccccatccgggggcgcaggtcatgctgaacaacaaccatttggaatcgcctgctagactttctcaaggctgcatcatcttcctgggaaaagcgcacgttttcaggttcaatgatcccgctgaggcggcggagctccggaagaacgaaaggcccacaacttgtcgcggctgagccttttgagttggtcgacgccggatttgaatgtgtcgatggagaatttacaattaaatgtcgaagacgacaaatgtgatatagaaatacaaagactgaatttggaaaaggagaaggaacagttcgagaaggagcaagaagccttcgagaaaagacaggaagtgtttgaaagacgaaggcagaccctggaagaggctcaagctaagttggaggctgaaaaggaggttgttcaaaaggaatatgcggagcagactcgtcaattgcaagaagattggcaaaatctcgcttcgcagcaaaggagacgtgaatctgaactgaaggagaaagaacgggaactgatcttgaaaagggagaaactcgagacagataggcagctgattttaggacagattgaacgtgaatgtgacacactgcaagatttgaaagcagatatcttaacgaaattctcgaatacttgtcagctagttaggtcctatgcgaatgagatcacttttccttcttctcaagccaaaaatacgtttcagcaactggtctcgaaatcagagaatactcccttgtcctatcaagaaactggaaatctcatagatattttgaacaatgtgaaaggttcgtccattatacaggacttggtggaaaaacataggaaagaattagccgaactacaaaccgaactgaaccgcagagtacaagctttgtgcgagaggcagaggagcgtcgaactgctagacaagaagatcgtagatctcgtcgaccagcaaaagtccctcagttccgatcagagcgagcaagaacacctgctgaatctaaaagccgaactctccaaacgaaccgaagaggaactgaaggacatcgaatcgaggaaacgggggttgagtttagatctgaaaccgatacattccactccgagtccggattcgtgcgaagtcaactacgccaacagcaacgacagtgctggggacggaaccggtacactcagcagcgatacataccatacagcagccgacagctgttctcccatctcctgcgcccccaggacaaaggacaacttgatgagcgacagcggggttgagctgagacgtcgtgacgacagtgatttgtctagcaacgacgataaggctgtcagcgattcgcagtcgactagttctgtggagaaccgttctccgaccacgaagaagaacaagaggaaagatcccgaacaggttctgcgaaggttgtcgcagagaatctcgcagcagaagcagctcatcttccgcaatttggacgggcattatccgaatgatcagttggatagccagattgcggctttgaaggaactccaaaggcagtactcggtcctcaaacatggaacttcgtcgatcatgtcccctgctctggaacatcctttgcaggatatcgacagtcctagtcctctgaggcctttaactaccggctcaacgtcagctctttactctccttccttgcaggtacagaatcaacgactgttaccctatcaacagaacttataccgttcgatgccttccattaacttagaatcagatcgagattctatagtgtgcataacgagttactgccttcgagggacgggcactaaaactcattacgaatacgaggttagaatatcgacagtcgacgacaggtggagtatcctacgtcgttacagtcgcttcagagatctacatatagcaatgaaggctcgttacagggataaggtggcttcccttcctttcccgtcgaaaaccctcttctcgaccaccgaaacggtggcgcagtccaggaaaaggcagttggagacttacctcattcggctcatcgagacgtgcaggagtctctcttcgtgtccgctcgcgtatggcgagcctgtcaccaaggccgcgttggtcagcttctcgccgttttttcggaaaggcgtcttcgagagcggcaagtacggaacttcatgattgaagtttcacctacttgtaagattaagaccatagttgaagttgatttatatttattattgataattttatcaaatttgttatatttttggaatgtttttaatagtgaatca

SEQ ID NO: 497 - DNA, 962 bp, Leptinotarsa decemlineata
  Annotation=Peptidyl-prolyl cis-trans isomerase H, putative; Tribolium gene name from OrthoDB database=TC010612; Blast E- value Tribolium Gene vs. Leptinotarsa Unigene=2E-13; Blast E- value Tribolium Gene vs. Leptinotarsa Unigene=0
tgtctctacagaatgttactttgacatttgtaccaacaccttgcaacaatggtacctccaatatgagacaacatataacttgaaatttatgagaaacattcattccttatactaagctgaaccgaattgaaaaaatagagtactgaaccaagttatttagggattgtagtgttgcatagaagtgttgaaaactgatttgcatgtaactccaattatatcacagcctaagatcatgagcctccttgaaaatcagtcagatcaattcttcactatattcagatcaagtaaaaccggtataaaacaaccccgaactaagatatcttcatttacttaaaaaaagcacaatttgattgaatttcctatttcacatttgtccacattgtacaattgtaacaggtatttttggtttattattgggaccagttggaacattttcgatttttctcatcacaagaagtccatcaatcactcttccaaaaactacatgtttaccatctagaaagttgcactttgcacatgtaatgaagaactgacaaccgtttgtatcttttccactatttgccatagataacaatcctggagtatcatgttttagtaaaaagttttcatcggtaaatgtgcctcctccgtatatactcataactccagttccatcaccattcacaaagtcaccaccttgtatcataaagtctttgattactctgtgaaaacttgcacctttgtatcccaatggaacaccatcttttcgaaactctcccgtacagaattgcctgaaattttcacttgatttaggaacaacatcggcaaataactcaaatatcattcttccgatttcagtagtgcctacagaaatatcaaagaagactactgggttagcaggatgcctcagttgagactgtatttgattccaattcggcattttatttgaaagtatatatgagttaaaatatttgaatgccgac

SEQ ID NO: 498 - DNA, 1784 bp, Leptinotarsa decemlineata
  Annotation=Transmembrane protein 184B; Tribolium gene name from OrthoDB database=TC003325; Blast E-value Tribolium Gene vs. Leptinotarsa Unigene=0
ggttattgcgttatcgtctatgtgaatatgtcaatgtatcgactggacaaatattgacagtgtaataattgagagattgtgtagattatctttgtttcttgaattgagatatgcaattggtttgattctcagaaatagtgactcaaaaatgttggtgactaagatatatttctaaataccataagcccgaaaagaacaacttgatatttctgcaaccatctgaatagaaagagaacatatgtcatccaggatggatgaaaacacatctacaagaacatcactttttgccgataattcctcaactgcttcgtcgattattcaagcaatcattccgccagctgatcaaatttttcttcaaacaaaatcgtgtcaaactatttctggattatttgtgtttgcagctctatttttaacttgttctcagatttatcatcacctgagatggtacacgaatccaacagaacaacgctggattgtgaggatcctatttattgtaccaatttatgctgttcattcttggataagccttttattctttaacagcgacaattactatgtgtacttcttcacagttcgtgactgttatgaagcatttgtgatctacaattttttgtctctttgctatgagtaccttggaggagaaggaaacataatgttagaaatcagagataaacccatcaaatctacatgtttgaatccgttctggagtggaaaaacatacacaattggatttttgagattttgtaagcaagctactctacagttttgtattgtaaaacctctcatggcattcgtgatcattttccttcaatcttttggccattatcgtgatggtgactggagtcctgatggcggttatatatacatcacaatcatatacaatatatctgtgtcgcttgcattgtatgggctcttttcattctattttgctacacgtgatttattgacaccatttgaacctgtactaaagtttaccactgttaaatctgttatcttcttatccttctggcaaggagtaggcctcgctattttagagaaagcaaatgttatctcgccagttataaataataatgtaactagtaccgttggcacagtgtctgctggataccaaaattttctgatatgtatagaaatgtttttcgccgccatagccttgaggtacgcttttccatatagaaaatatgctcaaggttgtttaaccgactcgagaggaaggtctgtgacaatgcagagtatttcaagcagtctcaaggaaacaatgaacccaagagatattatgactgatgctattcataatttccatccacagtatcaacagtatacccagtatagttctaaagtcccttcacgacagccttatgagagtttatgatatacacaatacagcgatgactaaatcgctgatggccgttttagctgcattcctccattctctgtttctgaatctaccagcagaattgcatggtggattcttgttatgagataaatgtactattctgattgtagtgtttttgaatgttacttatttttttttactcatgttatataattaattttaaatattcacctataatcaataaacatgttcgataagactaagttcctttctttgaatataattgaatgggtgatttttatttatttatttattacatggattgaagcctattataaaaaaagtttatatttgctcttcactaatcgattaccaaatgtatagaatagttattagtgctatacttgtaaattcatatattagaaaaataaaaataatgtcacacaat

SEQ ID NO: 499 - DNA, 3249 bp, Leptinotarsa decemlineata
  Annotation=GPI ethanolamine phosphate transferase; Tribolium gene name from OrthoDB database=TC015930; Blast E-value Tribolium Gene vs. Leptinotarsa Unigene=0
ctcaattccagattccaattaaccccgaaatggggaggtatttatattatttcctttttatgttatgggtatgttatttaataacatcatcaataatcctatttaccagaggatttttactcactagaactgttcagcaaaaaaatgctacttgcctttcgccgaacgaaattccatgtacaacagtggattcaaatgactaccaggaacaatgttcctctaatgataaggtttccaacattctaagcgaatatactagtgcctctgctatatgcctgccccccaaagcaagagttattttgatcatcgttgatgctttaagatatgatttcaccacttatgatgacagaaatctggatcctttacctttccaaaataagttaccagcatgaatggcttattaaaaaaattccctaataatactcgtctgtataagtttgtagctgacccaccaacgacgacaatgcagagattgaaagccttaaccacaggaagtcttccaacttttattgatgcggggttcaaattttgctacctcggagatcagtgaagataacatcatcgatcagttaattagacagaatcatcaaatagtattcatgggagatgatacttggaatggattatacccaaacaggtttacaagaagtttttcttatccatccttcaatgtatgggatttggatacagtagataatggtgtgagagaacatttatacccagaaatgaataattctgattggagtctgctcattggacattttctaggagttgatcactgcggtcattgttatggtccaaatcatcctgaaatgcagagaaaactgagtgaaataaacacagttatagaaaatatcgtccaacaaatgagcgaaattgaaaacacaatcctctttgttattggggaccatggtatgactgcgacaggtgagcacggaggtgagggtaccgacgaagttacatccgctatgtttgtttattccaaagaacctctatcgaattttgaatatacgaactcggtgaagcaggtagatttggtgcccactttatctaccttactaggagttccaataccctttcaaaatttaggaatactcgttccgaattgcttgccgaaaacaagtgaacaagataattggcgaatgattctttattccttgtgggcgaatactcagcaaatggtagagtatataaaggaatattctgaaaacgaaggcactcttgatcagaataggttgaactcgttcttccagaagtactccattctcaatggaaaaatattttccgtcgataacgaagagaaattcacaaaattttctgaagaagcaattaaatttctcggcgacctgcgtcacttgtgtgaggaaatgtgggtgcagtacgatgctttctcaatggccagaggactccttttctcgtttttgacagtatttttcgtattcgtcataaccgacggtattccttacgaaacgcttgttgcaatattttcgagctcttacgtgatgtgctcctacgctatggtgcttgtagctgccatgtgcggggcagttttttattatttcggtttggcagagaacttgtcatcggtgatatttttcgctacaggcggaatgtcgcaggttatgttggcgttgattatcctccagaactgggaatcgataactctaaattggtattcgaagggtaaatcagacaggctgtccaatctggtatgccgcctcgttttggtctgcaacttatgcgggctgttttcgaacagcttcattgtagaagaatcctttgttcttctctttttactaataaccgttatacttgttgggtcagtaggtatagcttcttcgagtaaccaaacagaaaccaagcggaagcaaggcgtgattaaagtcttcagttggtccaaagttaaatttctaatgttggcagtagcgatcgccgccttggtcagaagttctatgtatttctggaggtgcagggaagaacaacactggtgtttctcgatgcatcacgaaattggttacacaaccaaaacagaaaccaccaaactgcaatggacaatcaccgtgatctgcctgggggttttcgtttttgccaccaaagaatggttgaaaaacgcgggaaatttgaacggctactctctgacagtcaccctttccaagtttttgcctaccgccatcgtggtgtgcatcgccgggttttgggcattgaaaagagtgccccctaacaagaaacattctttttctttaaaatcgattaacatgatggcgtgggctgtgtacggcttgacgtttttagggattatcacgtgcgtattgaaacccctctgtgcttacatctttccgtctagagaggctagtcaaactgacaactcgattccttccattttgaagaaactcaagagcgagaagaaatccgaagatgttccggtggtgtacggattgggtactgtgtacagttcagtatttataataatgggggtgtacatcacactattcatagctttacttttgggcgatgcagtggcgccatctgctgtaattatgtttatgacagcttgttttatcctgatagtaatttccattcttcgggtagagaaagcgacttctgtagaacaattattcgaggtaccgaatatatttatattgatttggattattttggcccagtactttttttatgcttccggacaccaaccggctcttcccaatatagcttgggaggcagcctttgtaggaacttcagaaatagtttcaaacaacttcattccaggaactttgataataataaatactttttgttcgaatgttctgattggatttttgttgccgttggtattgatcgcaccatttaccattttcgtaatgataccgtcagtgtgcgagaaaaacactgctatcaagcacgctctgttcaaaggagaagtcatattgtttgaaaaaaatggtctctttatgaattccttgttcacgctatgctgcaagtacattgtggggcatggtataagggttttcgttagcatgttagccgctacaatccactgtcgtcacttgatgatatggaaaatatttgctccaaagctgatcttcgagtcgataggaatgctggttactctgggatccgtgatgttaagttacatgatactaataagagttaacaaacaagttgaaagacttattactgctctcaataaatgagttgacctcacacacctgtgggtgttcacaatactagtctgaagtagtattaaagtaa

SEQ ID NO: 500 - DNA, 1409 bp, Leptinotarsa decemlineata
  Annotation=2-oxoisovalerate dehydrogenase subunit beta, mitochondrial; Tribolium gene name from OrthoDB database= TC000711; Blast E-value Tribolium Gene vs. Leptinotarsa Unigene= 0
tttgaaagtgaaatacgttgatagtaagttcacaaggtcattaccaatccactgtaattccaaatttttatcattagtatcaatataacaagagaataacaattttatttattcattgtgttgaatcgctatggctctaaataaaatgtgtaatgtgtttatgaaaaacttgaccaatgacttgaaattgtggaatagcgttaaaagaaatcactttatttatagcgcagatacaaaaatagaagtcgaaggggagagagccaaaatgaatatgtttcagtccataaatagtgccttagacattgccttgaagacagatgaatcggccattatttttggagaggatgttgggttcggaggtgttttcaggtgtactataggattacaagataaatatggtaaagacagagttttcaatacgcctctttgtgaacaaggtatagcaggatttgcaataggagctgcagcattgggatcaaccgctattgctgagattcaattcgcagattatatttttccggcatttgaccaattggtgaatgaagctgccaagtatagatatagatctggaggaacattcgactgtggtaaactcactgtaagagcaccatgtggagctgtaggccatggtgccttataccattcccagagcccagaagcctattttgctcatactccgggtttaaaggtagttgttccaagaagtcccatcaaagcaaaaggtctcttattgagctgtatcagggatagtgatccgtgtttggttcttgaaccaaaaattttatacagagcagccgtagatgaagtgccagtaggtgattaccagctaccaataggtcgagctgatattttggtacagggaagtgatgtcactcttataggctggggcacacaggtgcatgttcttaaagaagttgcggagttagcgaaaaaacagtttcagatttcttgtgaagtcattgatcttgtatctatactgccatgggatgtggataccatatgtaagtcggtgaaaaaaacgaaaagagtactcatcgcacacgaagcacctttaactagtggttttggagctgaaattgctgcaaccatacaggaagaatgtttcttacatcttgaagctcctattgctcgcgtcacgggatttgatacaccgtttcctcatattttcgaaccattttacttgccagataagtggaggtgtttaggaaagataaaaaaattaatcaattattgaataagttatgtttattcagccagatttgattatatttatggatttaaagaaaatgcttttatattattccaaccgacctatgattgtgatcaaatgtcatttgtatgaaattaattgatatttcattatgagcaaaacaactattttcacagttcaatttcacttatacctactc

SEQ ID NO: 501 - DNA, 1781 bp, Leptinotarsa decemlineata
  Annotation=BRCA1-associated protein; Tribolium gene name from OrthoDB database=TC015510; Blast E-value Tribolium Gene vs. Leptinotarsa Unigene=0
agataaaatcctttattttagtagaaatataaactaaatggttaaaattaatagcataattataatttctttttccttttttgtcgtttagaagtttggggagtttcaccaatagttacagtaccaccagctatatcttctctttcatcggatttctcaattaccctttgagcatcaatgaaaaacatcagatctctaacttgctctttcagttctctaatttctccctccttgtgtgctttcaactcattatatttttcttccaatttagttattttagattgccattgttgttgattgtttctcagggctttgcccaactgcctttcttcatttagatcatttagagttgtagttagttttgtttgctgctgctctactttcttctccaatgcctgtttttcttttgtaatagcaactagctttgatcttagctgtttattttcttcagatatgctgtatacattatccctcaggtgtttggtttcctccaacatttggctttctaaattcaataatttgtcctcaaaataaagacgctgttcttctaattgagatgtcaagaggtaagtgaactctagttgaacagaatctactttctcttgggcgcattccgattcagagggtggaccttctgatgccacaagtttaccatcagccttgttttgcagaagtctgtggacaaaattatcgcctttataatcccaaactctatgagagcccaattgaagagcatagcaatgcccagattccctataatgtgaagcggcatggccaccttgatatcttccacaaccaacatgcccacaaatgagacatatccaaagagaatcaggtgagggagctgtagatccgcattgttcacattcagaggttgcagcctgttctgggctttgaacacatcggcagacagggcaagtcaaatcgccccatttttccaagcagctggcatgaaacgcatgattacaaagaatagtcaatacaccatcaactgattcatccattcgttcaagacaaactggacaaattggcaattctgtgtggcctggtggtggcaaaccatcatgggcccattcaacattagacacccatactattcgacatatactatctggttcaagactactgaaaggtgctccgttgaaagttaaataaaactccattgctgcatcatggttcctgaatgtcaacagtgccatatactgatttggcatagagtctcgcaacacccttatgtggctaatatcacaatgacacggagctgtaaatgccaacaagtcatgacaggtcattgttgttggaactcctaataagcataaggtaagcgcttctttcctgctacttaatacatcttccttgtaaagatgcagtatgcctttggtaatttccacaaatggattgccactgaaaaaacctatttcaacctttccttcaattgcatcttccacttccccaataggtgtaacttcccgggagtacttaggaagaattccccaatcatctttggggctctctaaggagctggggaatgtttctacacttatatctcgaagctgtctttgacccctatttttttgtttggaatctgtatttagtaaagcttcagcacccttgggttctgatccatcagtcacttcgttgacttccactcttaaaacgcatttcgctacgagatccgacatagtttgaacaaatcatcaacaattttcttttttcatttatttcttagaatcaatcaaattttacaaaaacatttatttgcttaattgacacttcagtcc

SEQ ID NO: 502 - DNA, 622 bp, Leptinotarsa decemlineata
  Annotation=KH domain protein; Tribolium gene name from OrthoDB database=TC001207; Blast E-value Tribolium Gene vs. Leptinotarsa Unigene=5E-69
aactagatatcatatatttttgtaccgtcaatcgttttttgataatattacgtcgtttttatgacttaatctgctctcgagggtctctagtgtttatcaacgacaatcaagttggttctgaactgtgttttgtgaaatatgccggcttcgagtttattcgctgagatggatcggggaagcgctctgggtgaagaaagagccctccagctcgctttagagctgtcgatgctcggttttagcgagcccctgtccaacgtgtcggaacccgacagtcccggagacattggctcgttcaaccctctggccaacgtcggtctcgaagaggttcgctctaaaaatctcagaatatgaccgaatgtgttcctgttcccagttctgaacatgtggctgagatcgtgggtagacaaggttgcaagataaaagcactccgtgccaagaccaacacttacatcaaaacgccagtgcgcggtgaagaaccagtcttcgtggtcaccggccgcaaagaagatgtcgccaaagctaagcgggaaattctctcagccgccgaacacttctcccaaatccgggcttcgcgtaagaacaacctggcaggcttaggctcgggcaccagcacacctcctgg

SEQ ID NO: 503 - DNA, 3424 bp, Leptinotarsa decemlineata
  Annotation=Aly; Tribolium gene name from OrthoDB database= TC008121; Blast E-value Tribolium Gene vs. Leptinotarsa Unigene= 0
ttcttgtgttattttactgagatacgtgaaattattggggtgaaaacatttgccattgaatgaagcaccaattggactggtaggtgaaccaactctcatatcgctgagtctctgaaatgactaacgaaaacgtttttatcaaacaagaagtggccgatgatgaaatggatgttgacgaagacttacccactttgggtcctgcagcattgggtcttcagcgagttggaactgtaccccccccaaaacccactccaacccaacccactcaagttttaaatgctcgaggaatgcccgctaggattcgaaaaaagaataagctatttttcgatgatgatattgttaacactccacatcacagggttacaagtgcaaagaaacacaaaccttcgccagttaaaaaacaaactcctgttaaaattaagtcagaaaaaaatgaatatttgaaacccacgccaaagaaatccagtaaggaaatcaaggatgaacccaaggaaaattccttaccacctctgaatactcccgataaaaaagttggacaaaaaatcggacatcgcttgagaaatttgcttaaactccccaaagctcataagtgggtatgttacgagtggttttacagcaatatagacaactgcttattttctggcgaaaatgatttcatgatttgtttgaaggaatcatttccggaattaaagacccgagaattatccaggattgaatggactaaaattcgtaggatgatgggaaagcctcgcaggtgttcccaagcatttttcaatgaggagcggcttgaactagagaaaaaagaaaaaaaattagggcattgcagcaacggaaagctacagatttgacaagtttcaaggatctcccacctgaaattccaatgcagttagttataggaagcaaagtaactgctaggcttcggaaaccacaagatggtctcttcacgggtagtattgatgctgttgatacttccaacaatacatatagaatcactttcgaaaggcaagggctgggtactcacctgtacctgactacgaagttttgtctaacgaagctcctgaaacgatatctcttcaaagctttcgagctaagtttcgcccgagaaacagcgccccactcacaccgttgaataacaagagtccaattttgaacaaccttaaattcagaaaagatccattattatctggttcgatgctcaacaaaccagttctccctatcaatacagaggaaggaaaaataggcggatttccggcaaaacttctagagaggatggttttggttacgaaaatcctcaatgtaaaaaactcaaaaataaaactcatcaaatgcatgaactccgaagcagaaaaaatgaattctttcgatcaaacgattccggaggagtttgagagacgatatgcgagtattttaatagatttagaaaaactcaatatcgatttgcaaatgtacctggatgagatgcagatctactgccaacaaatagccccagaacctagcgtagctgcaatgttagcaccgtcacatttacgcgaaaaatgtagggaggaagctacggacattgtcgataggcataatatgattattgctggggataagagttcttgtcagaaccctttgattctcgatttaataaccgatctgacagctcttctgttgcaagtgaaatgcttgtcagattctgagcagaattcgtatgaactccaagtacttcaaggcactatggaacagattaaaaggaaattgagcactagtaaccagccagtttttcagagtaatattgaggtccatgtgaaacaaattgaatttggcttgaaccaggtgaatatagacaaacttgtgatagggacgatgcaaacttgatgttttatcagaaaaaatatttgaattaattttaaacttttgtttaatttgataaacggttgtcacaacaatgtaggaaaaagaaaaactttccataatgttgtataaaaaagggacagctcaaagattcttagaagaggtctaaagttatatggtattttttattgttcttgataacaaatttttctcctctctaaattttggttatcattatattatcagtaactaaagtggttatacaaggataatgtaagtcagcgtgggagattcaaaaattgaaaaaaaaagaaatttgttgctcaattctcttttgaaatccttccaagtgaatgatatattttatggtatcaaacacttgaaataaaaacatacaatgtatgagaaaaattattttgaaatgtttggctttctaacaaatttcatgcaatacaatttctaattttttcaacagaataaattaatttttctgtttgtctactacatataaattcatttaattgatgaaaaccaactgctataacagtatacagttggaaccaaaaataatacacatgtgtcatcaaattgtgcatctagtataagttgacaaaataatgaaaaggaaaactggatgctgttccaaacaaccaaccttataatgaagaattgtttttatttttatatatcgctgaaaagtaacccccttttaggccaattttataagattcttcagcacagtaaaaaattatatttgagtaacattgaatagagatacttctaatttgaggttgaaattcataattatgatttaaaatttgactaccgagaaatatatacacccattttataattcgtaaaaacaactatttgtgtgttataagacaattggaactgtagcagctttttcaacaaacagcatataaactatcaaacgatagtaataagtcaattggtagaaagactactcgcgtttatacagctatttcccttcaatgtactaagttctatctatcatccaaacggtccgagacctcttctgttttattttctttttgatttatagaaggaaataatgctataaacaagtacgtgtttcatcatatatttttttgatggtacatgtgtattctttcgttgtcctcaagaaagtaggtgcactgttagcagtggttgattaattatgaggacttacaatttaaaattggttattctgccaaggtttctgtatgccaaggcttatttatttccaaattatttaaaagtacttttctgtattatgaattgaaatgaaatacttttatatgaaatactttatatatattttcccaataaggtagagaaagggttggaaagaggtaatatggatgtgattttacattttatccaagaaaatgtatctctaatgttttccttttttactccaatattgcttacctgttcaagcatagacttctgtgcaatattattttatatttttattgtgtgctgtataattctagtttattactatcctatgctttttatatttctaatattattttgtattattttgtgtaaatatattttataatatattttcattgct

SEQ ID NO: 504 - DNA, 837 bp, Leptinotarsa decemlineata
  Annotation=Membrin; Tribolium gene name from OrthoDB database= TC013356; Blast E-value Tribolium Gene vs. Leptinotarsa Unigene= 9E-99
acgttaccttgactttcaaatagtttttaatgaaataaatccaatttcgcttaatgatgaggcgatattgataaaaaaaagcgatgatagtattcagtcatggacactctctacaaccaaaccaacaagctgatccaacaaacccaatacaactttcaattattggaaggtagcggaaaaaatgcggttgaaattgaggcagatatccaagaaaagctcgacaccattaacagtaactgttcaaaactggacttattcacgctgaagttgcctctggaccaaaggcaaaacgcaaaaatgcgttgcgatcagttaaagtacgacagcagacacctgcaggccgcgctagtagcctcgcaacagaagagggcgcgtagagaagcagcgctcagcgaaagggagcagctgctgaatagaagattcgcccccaatcctgatgtcacagccataaatattgactacgctattcagcatcagaattctctgcagaatgccaacagaggagtggatgagatgttacatacgggggccagtgctttggagtctctgcgctctcagaggatgacgttgaagggagcccatcgcaaaataatggatatggccaacacgctaggcttgagcaaacataccatgtcactgatacagaagagggcctcggaggacaaagttattatgattttcggcatgattataacgctcattgtcattatgttggttgtcatttattttacgtaatctaagaaatttttagaggaaattcaactatggctatagactaaataatttctaccagactgtaggactgtaccctttttatatttcatcattaatactaga

SEQ ID NO: 505 - DNA, 2614 bp, Leptinotarsa decemlineata
  Annotation=Seven up; Tribolium gene name from OrthoDB database= TC000441; Blast E-value Tribolium Gene vs. Leptinotarsa Unigene= 1E-6; Blast E-value Tribolium Gene vs. Leptinotarsa Unigene=0
ggtcgaaaagtgtcttgaacttggtgtcgaggttcatgtggtgtgagagtgcagtgcgtgcgaggtgaggttacctcctggaaaacgtggagcgcctcaacgccatggctttggtagccagttcctggcgggagtcttcgctggtcaaccccataccgaccagcctgaactcactgtcgaacggtcttaaccctttgccccccacaggtaacctgaatccgttaccatcgaacattaatcctatcactctggagaatcctgatgtgtcgctcctcaaccggcaaacgccatcgcaaaactctcagaatagcgccaacagtgtcgataagaaccagaacatcgagtgtgttgtgtgcggggacaagagttccggtaaacactacggacagttcacgtgcgaaggttgcaagtcatttttcaagaggagtgttcgaaggaatttaacttactcatgtagaggtagtcgaaattgccccatagaccagcaccataggaatcagtgccagtactgccgtttaaaaaaatgtatgaagatgggcatgaggagagaagccgtccaaagaggtagagtaccaccatcgcagccttcgcttcccggattaccgaaccaattcctcaactccactgattcgatgacgtcatctctgagcaaccacacgtaccttagtagttacatatctctacttctgagagcagaaccataccccactagcagatacggacaatgcatccaaaccaacaacataatgggtatcgataatatctgcgagttggcggccaggttactcttctctgccgtagaatgggcgaggaatattccgttttttcccgatctccaggttactgatcaggtggcactacttagattagtttggtcagaattatttgtgctgaacgccagtcagtgttccatgccgcttcatgtggcgcccctaatagcagccgcaggactacatgcgtcacctatgtgcgcagatagggtggtacaatttatggatcacattaggatatttcaagaacaagtagaaaaactgaaggcgttacatgttgactctgccgagtactcctgtctaaaagccatagttctcttcacgactgacgcttgcggattgagtgacgtggctcacatcgagtctattcaagagaaatcacagtgcgcactggaagaatactgccgatctcagtatcccaatcagcctactagattcggcaaattactattgcgcttaccaagcttaaggaccgtcagttcggcagtgatcgaacagttatttttcgtcagacttgtaggcaaaactccgatcgaaaccttgatcagagacatgcttctgtcgggaagttcgttttcgtggccgtatatgtgatacttgaaactgtactagtaggggtgctagtcaaactgtattctcaactggggggaggggcaggtaggtgaacgtcaactggatgctgattcattcaaaacgaattcctggatcggcagtgataaaaaaaggaatcgaaaagatttgttttttcttgtcaatgcacacaaattgattagcgaactattagtacatgctggaattctctgatattattcaactggtttgaaaagtaaatgtttgtaatgatataatttcagttttgtagaatccttattcaacgaaacctatgtactaacttagtgaaataaccgtcagccccattccaacaactccagtctgatttagcgtacatcagttgacgttccctaccttgtttacctggtttgctcctttgaagtaactttacttcacaaatttgtgcttcgacacagggtgttgtttgtctgttgtatgagtgtgaaggtttttatgtttctatggaaaatagcagcaatcggatgtttatagtttacatatcataaggaggaaagttcgagcaaatatcaaattgccaaaaataaatagctgagtaatactcagataaaataaatgttcctttttatatcaaaaagaattaagtagaagtatgaatcatttaattcaacaccatgtacaggatgtttttgaaatccgagtcaattatccttttctctaaaatgctcgaaccagaagatttctatacaaaaactgtttttcataaaaaaactgttgaaaaacatcaattatttggctggctgcactctatattttctattattccttcttccctagtccgagtcaactttcataaatgaatattttttttgaattttcagtcagagatatctcattttcgaaaacatcctgaacatatatatgtaaatgtattggtaatatattttattggatgtgtaaaatatgtatatacagagttctcatgagaaataaccataagttaaaagagacaactaatttgttaacaaattatttattgaaagccattgtataagcgtatatttctaactttggccaaacgggctctacaaaacctttaaggaaatgtgaggcattgtggttcacagcaaaataaaacaatgtatagaaagtaaataaatatccaaaaacaattgtcatatcaaaaaaataaattatttcagttccttgaacctatcatcatgtttatttcagcactcgtatgtgaatagtaaatgccaaataaatgagcctgt

SEQ ID NO: 506 - DNA, 1256 bp, Leptinotarsa decemlineata
  Annotation=Protein rogdi; Tribolium gene name from OrthoDB database=TC011795; Blast E-value Tribolium Gene vs. Leptinotarsa Unigene=6E-122
tcacaatcgcggtgttcaaatatctaccagagacaaccaatcactatacaaacgaacagatcgttaattaaattttcattagactggtgaatttgtgattgatttatgtaaatttatgggctgtgtatttgccaggtgaaaaagaaagaattattttcaaaacaactatggttgattgtgagaggcacgaagcttcaaatttgcaaaaagaattcgaatgggtattaaaccaagaagttcataagggactggcccagattcaccaaattcttgtggaatgtgctaggaggtttcctgttgcattatatggacatgataattcatccaaacaagacaaatttgtcctctctgttccagcagatcagttaaaatgtgttgtcacattgactggagatagcatcacacatgctgatataacgttcaaagttgtaagacagaccacggcaactatggttcgcaccacgattcaaagtgagtatccatggaaactccaacaggttcaagatgcagcaaatcatttacaacaagcaatttatcatattgacgatgtgggaaaacattataaattcagatcctctgacgaagtcctacatgtactaggaaacatattaggtagtttacagaaagggcgtaccagtttgatagtacctagaaaaaaactatttacgatttattgaagagtcgtaacatgaaatcactttctccaccgttggcagaagacttggctataagtttttatatacaaagtcacaagctggtatttgttatgtatcacttaatgaataaccagggagtgatgactcctgatcctacaccagcagaatgttcagtgccttggcttaatgaagtattagtactttttacagttggattgcaactttgccaacagttgaaagataagatctgcgtgttttcacagtataaagattttactgtaggttcgagacctgctagcccccagtcttgttaactaagaatctcgataagtgtttaaattgcatcgtcaattttgctagtgtcaactacttatattgtaaatattttagatattattagaatatgtaatgtatataattcatgttacaacttctagtgtaatttatagtgagatattacattgtgaaatgtattttaatatcgagttggtgataaatttactaatggctgaaatgaattttaaagaaagcttaaatattatcaattatttattgtctagaatgtggaacactcaaaagttttaataaaggcatcttaag

SEQ ID NO: 507 - DNA, 1541 bp, Leptinotarsa decemlineata
  Annotation=Alpha-1,3-mannosyltransferase; Tribolium gene name from OrthoDB database=TC013994; Blast E-value Tribolium Gene vs. Leptinotarsa Unigene=0
gattgataatggaagaaactaagaaacacttcaagtgggaaagtatgatgtgttaaatttaaatagtccataaataagtcttaaaaaatgaatagtgacaaaaaactgaaaattgctttcatacatcccgatcttggaataggaggcgctgaaaggctgattctggacattgcaagtgccttatctcttgatggtcaccaagtgaggttcatcacaaatcactttgacaaaagtcatgcatttgatgaactcaaaaatggtgattttcctgtagaagtttatggagattggttgcccaggagcatatttggaaaattccaagcgttatgtgcctatataaggatgatatatttgtccatagtatacattctattcatgagagacgagaataaacctgacctgtacttcacagatttaattccaatagcaaatccatttctgaaattggctaatgagaaagttatttactattgtcatcatcctgacttgcttgctagtgctcctggtggtaagctaaagaaaatttataggaaacccattgactggcttgaaatgaaagccaccggtcaagctgatataattctagtcaacagccaatataccgcttccgtatttcgaaagacgttccctgatataaaaaagtcaattcacattttgtaccccactatagcaaattcctaccaaaaaactgtggaacaattgagaacaatgaagcctatagaaaaactagtgccagaaatccaaagtaacagtcaaaacaagtttgtatttctgtccctaaatcgttttcatcctgctaagaaacttgaattagctatattagccatgacacaactaaaaaatattgtttcaagagaggaatgggacaaaattttccttctggtcgctggaggatttgacccacagtcgaggatcaatgcagaaactttcctggaacttgttacattaaccaaagaaaaaagtttagaagataaagtgatatttcttaagtctccaaatgataatctcaaggctgaactactcaactcatgttcttgtcttgtatatactccagtgaaagaacattttggaatagtccctcttgaagcaatgttggtatctaaacctgtgattgctgtcaacagcgggggccctcgtgaaacagttgaccatggagtaacaggatacctctgtgagccaaattctgatagtttggctgactttatgtacagggtgttgaaagataatattaaagaaatgggagcaagaggaagagatagattggatgataggttttcttacagtagtttcaaaatgtgtcttaaaaaaatcgttcgaaaggctgttgaagaattttagaaaattaatcagttgacatttgttaatgtacataaataatatatttgatacataataataattttaagcattccaattattagttgtagctggaagcccaaaagattaatgttgaatatatctgaaattgtgactgatgttaacagaacatgaagattatgattcatctgcaatcaataaagaataaactagtcttataaaat

SEQ ID NO: 508 - DNA, 4059 bp, Leptinotarsa decemlineata
  Annotation=IKK epsilon; Tribolium gene name from OrthoDB database=TC009798; Blast E-value Tribolium Gene vs. Leptinotarsa Unigene=0
agagagctagtgtagtgtatttgtatttgtttttagtttttatttgcggtttttcataatagtttacagaaatgtgtcacattctcaatgcttgagagaacatattattgaagttgatttttgaagtttatgaaattagtagaaatgcctctcacattcatcgcttactaaagttatacattattctgaaaaaaagcagtaataaagcctttcatgttttgggtgtgaatcccaggactccaatactcaagatgtcatcttatttacgaggctccaccaactttgtttggtccactactagtattctgggaaaaggggctactgcaacggttcaccaaggagttaataaagtgaatggagaacctgttgctgtaaaaacatttaatcatataagtacacttagacctcaagaaattcaacttcgagagtttgaggttttgcagaaggtcaaacatgaaaatattgttaaacttcttgctatcgaggaagaacaagagaatagaggaaaagttattgttatggagctgtgcacaggtggaagtttgtttaacatactggatgatcccgaaaatacttatgggttagatgaatcggaattccttctggttttggaacatctgtatgctggaatgaagcatcttagggataacaatttgattcacagagaccttaaaccagggaatatcatgaaattcattcgagaagatcgcacaacagtctacaaacttaccgattttggggctgctagagaacttcaagaaggtcagtattttcaatctctgtatggtacagaagaatatctccaccctgatatgtacgagagagctgttttaaggaaaaacgcaaacaaaacatttggagcaacaattgatctatggtctattggtgtaactttgtatcatgttgcaacaggaaatttaccatttcgtccgtatggaggacgcaggaataaggaaaccatgcatcacatcacaactaaaaaggaaagtggtgtgatatctggtattcagaccaaagaaaatggcccaattgaatggaagcgagagcttcctatgaattgtcaactaagttttggtttgaaaaaaatcatcactcctttattggctggtctgttagaagcggatcacagaaagatttggagttttgagagatttttcaaagaagtagaagttgttttgtctcggaaagtggtcaatatttttcatgtgaccaaagctcagttgataaaagtatacattttgcctgatgaaacataccagcagtttcaaaattacatagcagaacaaacagaaattcaagactctagccaaattttgatatatcagaacagtctctttaggagtcttatagacgagtataccctagcaactggttatcctaccactactaaagaggaccccctttttttatttgacagagaaaataataacataaccatcattccagatcaggagttgccaaagttcaatgatttttcaagtgtagtttctgtggaaaatgatgcagtccaagcaaagtttgcttgtagtataggacatcagtgcaaaagacaaattgagaagtattccttgttcagcaaactgatacgtgatacagtagaaaatttcagtaaatatataaatgcagaactgaaacaattgcaccaaaatacacaacaccttcttgacaaaacaatgatattcaatagtactgcccaaatgttggaactgtcccagcaactaactaattatgacctaaaaaacaattatgtggataagctcaacaagattagcaaagaatttatgtgtgtaatagaaggtggagtaagtactttacataaggttcactgcgtagaaaatacattaaaattacaatgggatagtatgagtagagatctgaagtgcccatataaaacattagcacctgctagagcaaaaactcaggtagaaaatttgagagattcttggcaacacttagttagagatcgagcaactcgtaccttatcttataatgatgaacaatttcatatattagaacgaataaaaattaccgaaactattagtaggattaaagctttatttgaaaaagaagtgtttccccagtacgaacaattagctgaaaattttggcgattggtacaaaatggcacaaaatgcccatttaaaaacagaaatatatattggtgacattaacaaatttggcaacaacctgcagaaatttgaagaagaacttatgatcgataatgcagaatatactgaatatattaaaactcatcaagttaaaaaaaatattgtccctagaaagagtcgaaatacacaagctcaaaagtttaaaatgtatttgaatgaatgtcgtaaggtgagtgaggatctccgagataaaattaatgagaataccaggcttactaatgaattgaatgagtccaccaagaaattggaaaatcaatataacaataaggataaggaaatcttatttggatgactttttgttggtatgatttatttaatatattccatggcaagttcagttttacaaaaaagaaacaaatttttttgactgtttggaaactgatcaagattcttgatgtctatttcattccagaacttgtgaaggtggagacttattttataaagaatattgaatagataatagtagttgtatatatgtaattaatatattcaaataagtgatttcttattgagtaaaaaaaagtaattggttcttgtatcaattatggaaacctcctcctgtgatatattatttcaagtatatcaatccgatcaacactttcttataagtaaatggttgatatttaaaaaaatatctataacgtaacattgcaattacagaactgtatagtgcgttctaaattattattataagttaaacataaattaaaggggtatgtttttaggagagattaatttttgggaaagagaggttttggctttctactgcttctttacacaaaaaaagtggtaatctcccaaagaaaggaagaaagcaattaatttcaaaataaactctataccaaaatgaagatggagaagtaggaagtcaaaacctttctgtcccaatagctaaacatatattagtgaatatctcataatgaagtgtttcttgaaaacatatatttgattttgttttattattttttttgagggcttctaaccatctacaaaacaaatacactgagtagataagtatcatcaaaggcaaaccgaaaaattcaccccatttataaagttaatagatgaaaaaataaaaaaaaagtctggtcggtagctcccttaagttacaaataaaattaattaaaaattatttcatttagttctattatataaaagagggagataattgaaatacctgacaaaagaatatatgcagatgctttgttttttgacgttttcctatagttttttgatgatgacttttgtttgcttctactcaattctatgatagatatccatgttcttgttatgtcttttcttcaaatattcatgatgttggctcagttatacatttttaggggtcttgttatttgaccaatatatattttgccatattgatttgaattcattcttttaatgtgcaaggttaagaaaccaaaaaaaaatcaacattgtcgcctctataaaacatgtcagtcaaaatatattcacttatttttgaatatggctcacaactattttctaccgactggtggacattggaacttttcaaatatgtaaagattcagtacttaaaataaaaataaagaatagtttataaactataggctcacaaaaaaaaatgaaatgtaaggtaaatagaaaaactgaaatagatgagattagattctaattttgattccaaaagtatataaaaaaattatttgtttgataattctggaaacaaaaattggaaacaacatcatgggttagcacatttaaaattcatttctacaattttatttttccagcttcatggatgattttctgcttattaattgattcattacttctgtatatcaatgttttgtgaaggcagtgttagaaggcttaccatttagatttttatatgtaatataataaaatagttt

SEQ ID NO: 509 - DNA, 2680 bp, Leptinotarsa decemlineata
  Annotation=Huntingtin-interacting protein 14; Tribolium gene name from OrthoDB database=TC008472; Blast E-value Tribolium Gene vs. Leptinotarsa Unigene=4E-57
gatcaattcaacggctgtcaaatgtcgtttataacctttacatttccaaattttgttttttcagaacataggtaaacattgaacttgctgaatattgagacacggtttaaaaaatgtatcaaaatgcttgtggagcagcagcagctagcgctggtgggtgtgttgaaacggagaaagaatgccatagtttgatctccaaggaacccactgtacctgccatagaacatgattatagtggtttcgatatagttaaagctactcagtatggagcattcgtgagggtgaaagaactagtattggcaggatatgatgttaatgagcgagattgcgagaatgtcacccttctacactgggcagccatcaacaacagaaaagagataatgcactttttgatagaaaagggtgcagatgttgatgcagttggcggtgagttgcaagcaacacctctgcattgggcaacccgtcaaggccatctcactgctgctgtgatcttgatgaatgccggtgcagatccaactctaagagatgctgaaggatgttcttgtatacatttagctgcacaattcggacatactgctttggtagcatactttgttgcaagaggtgttagtccagaccttgtagacagagtgggtatgacacctttaatgtgggcagtatggaaagtatgtagtttggaccccacgaggttattattaacattgggtgcatcaacaaatttgacagatcatcaaggtaatactgctctacattgggcaatattggccagaaataccactgctatatcaaccttgattttacaaggacatgctggccttcatgctcccaataacagaggtgaaacaccattgtcgatgttgcagtctcaaattgggtgtatatgggttagtcagaaagttactgacatcataaaggaaaactctcacacatctaattctagaaattattttaacaagataacaaaggataagagaatgaggtggtggtgtatggtgggaaccccttttatggctttctacttagcaggagcaatactaagcacaaacttaataatcctaataaaaatatttcttctagtctgcttatacatagtgatacattacgtcggccaattgttgtacgacgacaggctaatggcacttttaccgctcagtatttatttgtcgacgaaagcatggttttacgtcacgtgggtgatatatattacacccgtgacccacattcttctgaccgtcttcttccttgctagctcggggttgctgtggtactgctttttgaagtcgtggctcggagatgcgggaatcgttagcacgtcccaacaattgcagttcagaactataattgaattagctgaaaaaggaccggcaggatttgaatcgtcttcgttttgttcggcttgtttggttaggagaccattgagatcaaaacattgtgcggtatgtaatcgttgtattgcaagatttgaccatcactgtccctgggtggcgaactgtataggagcaaaaaaccacatgcacttcataggattcctggcaagtttggttttaatgtgcactcaactgctgtacggttcatttaaatattggcaaaatgcaccaaactgtaatataactgacaatgcagaaagtttctggaaaacgatagttactatagggcagtgcaatacatgggttgcttgggtcgcactcaatgctcttttccattccatatgggtgttcatgttgttgatatgtcagatgtatcaaatcacctgtttaggaatgactacaaatgagagaatgaaccgtggtcggtattcgcactttattgctaatgggggtaaaagtccgttcaccaaagggcccgtatcgaacctcatcgatttctttgattgttcgtgtttcggcatgatcaaaccagagtcgaaggactggttgacaagttatgatatcgataagaatatcgagcatcagcctcttttgaggcacaaggacaatttccaatacgtatgaatttacatttccagagagttgactgattttaggaaatggaggataccatgaatacctcttcaatttaagctgaatagatgtacattttgaatttttcacaaggaaaagtagcgaagaattgaagctgatattctctatttactaagctaatttttatagtgcgttgtgattggattttttcataatttttgtaaatttttttttatcgctaaatgaatgtgatttgatacaaaaaagtagaggtgaacctttaggattcgactggttcttcgtgaacgaacttctgttgtaaagtatttttttgtgatgccacttattgagtcattcagaaaaaaacttgagcgattgttagttgtttgttaagtttttatttatatattatttctagcgaaaatatttttatatattttcatttttagtgatgtctgaaatgtgtggatttactaaaatttctcaattcaattcaaaataatacatatatcagatattataaaaatcgccttaatgtgtttaatattgatgtgaaaaattgtttttacaagcaatgttgatgtagataaaaattatataaatgaaacgaataaaaatgcacatcaaattcaaatatctatttataccactaaaatattcaattgctcggcccacaggcaggaaaatatttgtgcaaatattgttgcaatgaccatttt

SEQ ID NO: 510 - DNA, 1730 bp, Leptinotarsa decemlineata
  Annotation=Microfibrillar-associated protein 1; Tribolium gene name from OrthoDB database=TC000456; Blast E-value Tribolium Gene vs. Leptinotarsa Unigene=6E-164
atattaaatattatataaatattatacataaaaaatttgaaggtaacgattatttccatctgtcttttgacaatatcttttatcacgtcacgtactaggttttgaggtgcagtcgtgcttgactcttacccacactctgatcacgaaatattatcaataaacgtactcactgcatttttctttttttccacgaaggtttctcaaagacaggttttacgccgccagcttgctgagaatggaatttctggttctgggcgttctcagttgaccaaggagagtcgaactgtgtagtgtcttgatccactaaatgagtgtacttcgtccgtcctgaccttccaaagttcttgacctgcataactttaggaaggatggtcttatcaaaatgatcctcgagtgtggcttgtgcgaagtccctcttgtagacttcgtcctccttatccaagtaaaacgctcctctgtggtaatatttctgcaaatacttatatttgcccttggctgccttgtttgtaacggttttgggcatgagtcgaagctgaatacgtcgctcctcttcagacatggtcctcaatttttctatttccattttctctctttctcgttcctccttttcttcccgatcccttttcactcgtttcaactctcgtaacttccatgcttcgtataccacctcgtcgttctcatcgtctgtgcaaacatcatttaaatttggttcgtttgtttccttatttcggaactgctgttccttacgaatggtttcctccactaggcgtaaagtttcttttctcctctcttcagcctttcgctgagattcctcctctcgttttttctcaagttcatgttccttttcaatggtagtaatcctgtctttttttctaatgaacacaggtttcagccttggtcctgtttcttcctcagagtctgtatattcctcatattctgaagaatcctcagagtctgactcatctttttcttcttctttagccataaactcttcctcttgtttgttcagcatcctctgcttcatcatttctctcttcttttcaatttcactgtcgctgagttcggcttctgactcatcatcgtctggtgcagcttccagagtatgtttattctccggcaaatgtattttgtcaccttcttcttcatcttctgacgaatctagtacttcgccttccacaatatgcctccgtctttcagggcgtacctctgtgtcaacttcagcgatttttaatcttcttaaacgcgggtcattgaaatcttcttggtcttcatcacttttaggcggttctggtgatggacctgatacatgttttatccgttccacaaagtcgtcttcttcactttcgctgtcatcgtgggcatagtcaggttttttaccagaaacataccgatgaactttaactttctgcatagaactttcgcctttctcgtttctcactggaacagctccagctgtgctttgaatggagtaattggactgagggttcatcatcttgaagttattgttaggatgtggatgtagggttgaatttcttttttgcaaactcaacaaatgggtttagtgttctcactttcagaattcacttcaaatacgtgtagcttcttagattgttgttataacaattatatttgtgtcaatgattattttcctgtatttttgtatgcctacaaaaatatgtaataaacaataaaacaactgcgagttctatctacgatatgacagctgacat

SEQ ID NO: 511 - DNA, 3664 bp, Leptinotarsa decemlineata
  Annotation=Retinal protein; Tribolium gene name from OrthoDB database=TC015415; Blast E-value Tribolium Gene vs. Leptinotarsa Unigene=5E-1; Blast E-value Tribolium Gene vs. Leptinotarsa Unigene=02
taaatatcagtgcatccagaattacatataaaactttaaaatcagaagtatttcatacatgaatcaacacttttatttaaaaactaccctgataaacaaatttgtcatttcatggcatcaatttaagacgcaaatgatttttaattagtggaagtaacttttctatttatttattagaataagtaagaactgttattcatttcatttttatatgaaatttgaatttcgtggttaatacattttccagttgaataatgccatctcaaaattaaaatgacttgtttggaaaactatacttgtaatttgcaaatatatttgaatttttttactttttgataaaaattgcaaatgataaacttaacatcaccataataaaagtctatttgttcaaggaacttttcaagcaattgaattggtaaagaaatatcaagggaaatttctataataattttacaaactacaccggaaacgccttgattttcacaaacttcatttccaaaaatatcacgtttctttatgacagtagcttttttgtagtgaataatattgataagtaaataagtaaaactattgtgatagctaaacatgatattttcggaaataaagcttgtgaagatcaaatcttttccagtgtagtttgtgaaataactatggatcttcaagtaatgacagagtcaataagaaactttctataatacttctgaaagagaatgaaattatgaaaatatttacaaaattcatgtttcatatttttgtctgaattttacgttaattttacttatatagaaactgaccttgttatatttctttggcaaagtaccggtcagtgggactaaattgttgactgttatcataataaaattgtgccaactaaaaatgacatattcctgtgtgcaaatcgttctcctaaaatatcacaaacataaaactaaccctcaaacatgggatgaaatactaaaatttcaatattttaaccgcttatttcagaaagctgattcagtaaaaaatgtaatcacgtcaccccatattcaaggatctatactattcattgtaaatatgtgtctaatagaatttctaaaatctaatttaaaatgcaacttgaacacttaagatgtacacattcagttaaaaattgaatgtttgaaaataaaattgtgtatgataaacttgtcaaagcagtattgattcaaatttatttgtaacaatcagtataggttttgtataccaacacagaaactgtttatgaatcataagtagtacttatttgtgtggtgacattcttttttatacaaaaatttgttgagaataatgattttactaatttcaaccagtgatcatgaaggtttcctatggaaataggaaaatcataagtgctactctctcctctacaaaactttgaaaaatgtatttttttaatttaaaatagtagaaaaaaatgtgtatggggctcaactttggtgaaaaaatattccaacgaaagtactgtgaaaaatatcaacattttgaaattttccaagttaattaatctcaaatcacaccaattctgaaaatagtccatgacataaaaaacaatgagtagttggaatatgtaacgttattaagatttctacttgagatgaatataacatccataaggacaaaataatatttgtagatatatgttgttgtattgtgtgtagaagtattaatttattatattcgaggaacactttattgtgagatttttactaatcagtttcacaaaaacgcaacacatttcgctatacaatagcttcatgaggcgtatctacagtaaggcctgtgtttcttgaatatgttatggattttcatcaagtatcggccgattccatcacatatataaatttattgtattgatatctgtttgattattttgttgattgtcaaaacaagataaagtagataataattttcaatttatctatataacaattttagattgaaatatctatgagaaaccaaatttaatttcttcaaattgagtctaaaaccaagtaaaatattacatttgaaacaaatttttattattcatagtattataataatagtgccaaatgttaatattgaataatttatctttcacagataaactccagtacccaaatacaatttttgctataccacgtagatgattgcttttttaataattatgatattggtgattttaattcaactgaattatttttgttttatcaccagaatatatctatattaatggagaaagcaacacaacaaaataaatggaaaaataatactgttaatataaatgaacattaatgtaagtaaacattgaattatagtaacaggttcactgtaactacaaataatttaatttaatcatcactatactcatagatatacatgattatcacacacgaacatagacttttcgaatattcataaaactaggttcaaaaataaaattgtatacatattcataaaaatctaaacacaaactaatctcattaaattattgttcaacttgtgcaaaatttttctcacaaataaatatatgatccacattcggcttttgtagaaaaaagtatatcacatatctcagtattaaaatatataatcacttaagtaggtatctgaattttatttacaaaatgttatagcaaaaaatcacatttgaataaaaaaaattgaaattagacaataattaatattatcagtacgttttccacttttgcaccaattttttattctatcgatgaaaaactcctctacatttcgaaaaagttttgattcaagcgcatcacgtgattattttttgaaagccagtgttcatgctcaaacaaacttttagtgaattatcatagaaatatcatttgaactgattaaatgttcaaacttctatcgaagtgtgatttttttttgcaaaatattgtgtcaaaattattgtattcttaaccctgtatcaataatttgaggttatgtagacataccaccattataagcatagtcagccttgttatgcataatgagacaattgtccacaagtaaaatgaatcagatctggtttcgaagggacatgctatcatttcattaacaagatcagctggtaatgaaggaaactcgtaaatgtgttcacatgtattccttgaaaacggaatacaaaatccaaattcaaagtcgaaagttttcaaaagcttgtctcgaaaaaaatgacgctctatcattctaaaattgttgaccggtctactgcccacagtaaattcaaccgtagccccaactgtttccaacttgagaaactgtggtgtaaattggtatcttacaaaccgtccagcattaggatcaattaattcatcattatctgaatttttgtcagtattatcttcaatattttctgggagaggttttgcaatttcgaatagaatagctccgctttctagatctctcagtttaaaccttgtaaagtcaatttcatatatatttgcatctggatcacacaagtacgtatctgttatttttgttaattttaacacatcttcaggtgtcataactttggaatctaaatgaggaagggatttattagaaatagtatctattttttcacgtatcacactcattttgttcaaaatatacaatacaaatacaagaaacaacaaaagctgactaaaacgtcaggctgacagatgacatt

SEQ ID NO: 512 - DNA, 1749 bp, Leptinotarsa decemlineata
  Annotation=D-glucuronyl C5-epimerase; Tribolium gene name from OrthoDB database=TC012612; Blast E-value Tribolium Gene vs. Leptinotarsa Unigene=0
acagtgattaatgtgagtagcatgatagtcccacctagcaagattgggagatgtgccaatagtgaagtgtctcagatcataagatgtaacacttcccatatcgaacaacatcagcatattccgtaatgatgccatcccctcattgtacaaaaactctgcttcctgggcctgtcctggaggggctatagctatcagatcgtaaagacccagcaaggaataaatgaatccatttagaacgaatgacgctggctttgtaggatactcttcataccagtggtatttattaacaaaagtagctctaacacctcctttggagctgggaactcgaaaaggtttcaggcctttcaaagctgcattgaggtagcggatgtcacctccagaatgatagtatgcccgagagaggacggaaattgcatggccttgacccatcgaagaataccaacctggctgcaaatcatgaaaactatttgccaacttcctccttaccggtattggccagcctcccgtttctgtatcctggtatttcaagaaccagttagcagcatcataaaattgttgaatatgttcggaagatgaaagagttaagttatctatggacccagaacctctcaaagtaatattcacaactttaatttttgagcgtaaaaccttgtgttttgatttatctttatcaaggtaagtcatacctttttgaagatctacaataagatctctagtaagttttttccattcttgagatgttccaataccatggtagatattattatcctgtactgtaatccaaatatcagatgttatataatgtagattatatatttcctttgtttctctattctgcaagataacacatagactactattaccagtcaagatgatgtcaagactaataacaaaatacaaaacatgatccaatgaaagtccaattccatcagtatactcttcagtagttgtgaattttaaaatattacttcccaatgcattgtcgaatactttatctagttttgcagttgctggcacaatccatttgatatcattttcacagtcttcaataatttttcttcgaggttctggctccgtcaagtttttactatagtgagacagaccaaactgggcgatttgggtggggtagtagtacccctggctatcccactgagttgagactggaactccttcaatggcactgacacacctaactctatctctcacttcaacattgtagttctcaaaatacataaacaccccacgagggtcatatttagctttgggatgatatactttgctgtaactatgtgaccattcaaatctctctaagccatcatatgtggccaattttccatagacttcaaaatatctatgaagaaatgaaaatggaatgtaaacttcgtctccttccttcctgcatgttattatgtattctccattaatatcacaatctatttcttcggtaacttgtaggtcgaaagttttggtgctggctttgttgaatttttgccattcttgttctgtatttccgcaaacagagtacagcactaatatactaagtatactaacagatagtaaaaatattagtgctactttgacattgagtctcatcattacaaaaaataaaggaggttctttcaagaggtgcaaacggctcttggaatagcctgttaatatttcggaatgattcatttagatcatcacattttccatcaacttatttagttatgtaaaaactttttcttatttcacataatgatattgaat

SEQ ID NO: 513 - DNA, 2553 bp, Leptinotarsa decemlineata
  Annotation=LIM domains-containing protein; Tribolium gene name from OrthoDB database=TC013882; Blast E-value Tribolium Gene vs. Leptinotarsa Unigene=0
caatataagtagtatctttattaccaactttcaaaaatggcaatgaactaaagttaaaatatataattgtatacaaaaaaatatatgacgttttataaaaattcaatttaagcacaaaatgataccagagctgatcttttacgtagagtatgaaaaaaagttatttcactaaaaaatgcttctaaattattcgttgtcaccaacacctagactagcattgattataaaaacttcaaaacacttttggcatgattaaaaaaacttgaaaatacacagtaaagttttctcatattccaaatttacattacaagggcgaattgaacatgacctaatttatttcaataattttcagttgagggtctcagctctggtatttctatcaaataatatctgaggtaatttccaatgtagaatatcaaaaactatactagagagtcgacgggcactccacgcggttcaaactgtaccgaacgttacaaccatacctagcagtctttcaaagcacaacaaaaagagcacctttgcggtggaaatgatgtgaaggaatgtgtagaaagtgaacattctggcaacttatcccgtgtattgaaaagaggctgccacaggatgcatctggttgggcatatgtttcaatgtctgtatatggcaattgcggcacatcagcctctcctccaatgggtaacaacgcttatctggttcatctgtcagttgcattccacattcttcacaaacataacagtccacgtggaaatctttatccattgatactactcggacagtttcctcggtaccttcaacaggggttatgcctttgccacaagctgcacatttgggggcaaacatcctgtggtagtcattaacgcaataaattttattatcgacatctactgtgaaagggactccatctaaacaatcgttacaaatacaacatctaaagcaacctggatgataagattttcccattgcctggagtatcatttccatgatgaggtgtccacaaatagcacatttctcagcagtttgctggaaacctgaatataagtaatcttcttcacagtagaccctgccgtgaacattgtaaaaggcctttcctcttagagcccttccgcaggagcaacatataaaacaattggtatggtacaagttccccatggcttggcaagcctgtcctgcacctgtgactttgtcaccgcatgtatggcatattccaaaatattccccctcttcttcgtgcttctccatttcttcctctatctgcctggtcatttcttcaatttttttttcagcttcagtaggacctgtcggtttgggaggtgttatgctgtatggcaacaaactttttcctgataattttaacttcccactactgttacttaaagtgctaggtgtaggactgggaactggggaaggccgaacatcaactttttgcggtactggaggtttcttcacttccttgagaggtgaaaccttcacaggcgtttgagcaattccagtgggaatggatctatcatagttcttggcagaagtggtttgaaaaggaatattagaacccaatttagattgaataatgttgccagtcatacaaacataatcaccgctgttcagttcatcaagctgttgctgagtcatacttttcagaggtgaactgctgtaattacggtaaggtgactgaggttgggcatttgaactactggaagcttgcatagaagaataaacaggctgatcagagtactgagaacttggcaaacaattactatatggcggaggtgcatttggaggtacctgaggtccaggcatagcacctgagcttttatgcggaaaattctgtacattttcatacactggtggaccttccatatcagatatgtttctgccaaaaggcacctgtggctgtgcttttgtataagtctttgattcaacattactcatccccccataataaggagcctgagcagctttatccgagttataatcaatattctcataaacatttgagttgctagctatacttgtcctagggctgccagcatgggacgatcctccaatggagtgtgtaggactcattggaacttgcggtttagcgcattgaacataaacatcactttcttcataaagtcttgggcttcctaatgtttctacatgttttggcgtcgcatatttagagctagcaattacattagatctttcatacatcctatagtcatttgactttgggggatctttattgaaattatctgtgattccaatggatctctgtttttgatgataggtaggaactgcaggttcagcttttcccatgttcatgtcacgtgtgtatcttgtctcatggtcgcttaaggacatatcctgcattttttttatatactgtgggtctgaagatttttttttgataattgtgttccatttttttcgggatgcttcgcaaaaatgtatttcaaagctacttcgtattgaatattttatgatttacagacaaatatctatgaaaatgtatttttttagtcacgattttcattaacaagaaactacaccccacacctcaaatcagcaccc

SEQ ID NO: 514 - DNA, 2177 bp, Leptinotarsa decemlineata
  Annotation=Nucleoporin Ndc1; Tribolium gene name from OrthoDB database=TC000485; Blast E-value Tribolium Gene vs. Leptinotarsa Unigene=2E-1; Blast E-value Tribolium Gene vs. Leptinotarsa Unigene=06
cgtgtctctaattatatttaaaccccaagaaaaattatatcctttatatcttttattcaatgttgttgataactattatgttcaatgttgaaaataaaacagaaaactatttttaccagtataaaatgagtacatattcagtgaaaaaatatgttgaattttcaatttaccaacataaataaaagtacaagccaacttccaaacactaattaacaataaaaattaaacgtaaattcacaaataataataaataagagttatttcataatagtacaccacactagcttttataaatagtttgcagatacaaggcaacatctttattcaaaggaaattcactcataaattttccaaaagtcctgcatatattgaataaacttcttttaacagccgctgatacagctcctttcatcttatagttgaagtcatcgtaccccgcaatctttttggatagggcactaattttgttcagtttgtctaaattctgtttcaattttactagagtactgactattgctggtatatccttctgaacaattccatacttatcttccataattgaagcacatgccaaatccgatatcccttgacaggtccagattattgtgagtccattggcaaggcacttttggatattggcttgaggtaattccccaaataaaaagttgattccaagaagaactttcaatattccaaacatgtttgttatcttttcttggagtttatccgttgcagctttcacagatgatataactggcacagatgtatgtgtaatgtcaacaatgtctgtcatcatatcggatgaacaagacatattacgaaggttttggtacttaatgggactttgtataggcacttgcggcaacggtttggaaactctttccatactttcggtggacttacttaaaagttctgtatattcagttaataacctcaagacactttctactaaagagttccaaatgtggggatgccctccaggttgtgagagtgtaaaaaacacttgccttctctgctttgaccattgagccaggttggagagatccagacaagccaaattttgtactataggaaaatccgatgtatgaatgaaatcttgaaggcacaaggaatcatctgtttgtttgcacggaggaaattccacaggctccgtaagaaaaacattgaagaaaaatcgcatcatgttcatattgaagtaatatattgtgctgaacatccacaacttcaagtaaatgaaagatccgtcactggtttctccttccaggagaccaaaagttgctcttaaattttggtaaaacatatttccccataatgtatacaaaaacacgaagtaaaataaaggccaaacagactttattaaactttctttaattaatggtattaattgagatttgaactgcagaactttgttttgatggataactggaaattctagatgtttctcagaaatatacacctttgcaaagtaatagaaacctgtccataagccactggaaatgagataaagcgaaccctcattcaaacagtaactctgacctttgcagatgctggtgagattttgatgctcccctccaagcgatagaaacatccatactgaagcagttcccactattatgttcaacaccaaaaggatcaggtttcgtattgagaaagctgatatgaattgctggaatcttgtagaacaatagctaggtttggagatgtagtctttggagcaaataatgctttgagcgaaaatgatcgtgatgaaaggtattacaaacagccatgtgctcaaagacaggaaggtgttcaccgttgacaatatccagtctgatggatgtgcgatattgatatttgatataaatacataggtcaataatacaataagttgtgaaaaaacactgcatatcactgaataatagagttttttcaaaagaaggtctttaaaagtaaaggtatttgttatgaggttagaattcatcttgcaggtttttcctcaatattcacttttataattcatcacagatataaacagttgataactttgtgattagtccataaaatttgtcgaaactttaagagccttcggattcgtttaatgtttgaaacttttaccgtttctaacttcaacggatttttaaaaactgattaactaaatacgaatacgaacatcacgaaacgagaaaacaaactcc

SEQ ID NO: 515 - DNA, 3230 bp, Leptinotarsa decemlineata
  Annotation=Ubiquitin-protein ligase E3C; Tribolium gene name from OrthoDB database=TC013932; Blast E-value Tribolium Gene vs. Leptinotarsa Unigene=0
gattcccaaacattctattttgtgatgggactaatagtatttactcatcagtcgaagattattcaaggtatcaatatacacacgtgttgcactcatttcgagaataatccatgaagaataataaaaatcttgtaggaagattgcattaaaattattcaagaattaacagtagtcatacccccattgggatagataatgacatatatattataaataaacttcaataacattcatttcctgtggacatatcaaaatcaaatatctagttttttgtaaaaatggctttcaaaatgagctattcctttgaaggaaactctaaaagtagaccagagcagaatttgtcaggatcaagtaaaaaattgagtaaggaatcacttttgcagaaaacccatgaagagagaagaaaaagacaagaacaaaggttgaagctacaaagcacgcaaatccttcagtctcatattcgaagctggattgtgagaaaacacaaaaaagatgaagaaaggcagctctttacccaattggaaaatactgcatcgaatcgagtattactttccaagctgttgttcttttacgatgccaaaacggacaaagataaattgtttcgattagccagtatcatatgcaactgtcatacagaattattaggatatataaatggtgatgcctccttttcttggttgattaaaagatatcttgttctttgcctcaaaacattgaacgaacatgaagataatgcagtgttgatgaagtctttatacattttcaccactaatgcttgtacattcgagtatctgataagaaaagggtattatacatttctaaggaaacaattggatactgaacatcagtgtttagaagaaattattattcttatacaaaaaccattcagataccttggtgagtcagacgctttgaacgacttatgcctgtcagggtttacttcaaattttttgaacagcacgctatctcacaatgtcaaaaatgttctgattcctcatctgaagaacaacagcaaagatttaccattcgaccaattgctgaaacatttgaatagtggttttcattttgacaagagtcccagcttattttacagtattttagcattggagccagatgattatgaaccaaattgtgatagtgttcaagttctctcaaaactcagtcgtaacattcatcaattgagaccgtcatctgatttaacgaaagaagatagcgacgatgaagaagaagaagaagagctagtaactgagcagcgattgttgctttccgactacttactcaacttgaacagatatgggagggtgaagaaattgttaaccttttttgaacagcactgtaatgatgaagaggttctgatggcattcacagtgttatgtcataatttgttgttggtttataaggattcaatgaagaagtatctgttgctgtataaatttggcttgaacagtttgtttctgaacaagttgtggacccacttgagtaaaaataaattcgaacagtttcagacaactggaacatatctgttttcttggagagattgccatacagcgttatctgttttctgtgatatgtttacatttttcactgaaactttaacggacagagagaattcggatacaagcgaaactttctcaaaaaaagacctgtattcgatgtcagtattgctcaagaacgtagcgcgggagctcattaaaataacttttcctatgtctcgatcgtgtgctgttcagtctactccagaagttgtccatttgtataaggcgtgtttcaattctgtgagagttttatatatgttggacttgaggaagcagttttgtccagcaggattctggacctctgaaaaaattcatatacctgcagatttgtctaggaaaaactatttttcgagtacacttcattcattccatggatctacagacggaagagaagatgaagaacaactgcctcctctttcgaccatagaacaacgttccttggccattctcgaagagctgcctttcctgataaacttcaacacgagagtattattcttgcgtgatttatgcagaaacagcttaggcccctacgattactacagacatcatagtgagttgctgcacgacaacgtcatagtcattcgaagaacacacatttacgaggatgctttcgaaaaaatttcaaataaaagtgaattggacttgaaacacaaagtacggatacagttcatcaacagcgtgggtttggaggaagcaggtatcgatggtggtggaattttcaaagagttcataaacgaggtcctgaagacggctttcgatccgaacaggggatttttcttgttgactgctgataacacattgtatccgaaccctaatgttcacctcatagtcaacaatttcaccgatcactactactttattggcaggcttgtagggaaagctattttcgaaaacattctggtcgatctgccgttggcggaattttttttggccaagttgctagtggaccgagctcccgcccactatttaaagtcgctggatccggttttgtacagaaatttactatatatgcgggacttcaacggagatatcaccgatttgggactcgacttcactacagttaataacgacttgggagaaaccagaatcatggagttgaaacccaatggagcagacattcctgtgacgaatgagaatcggttggagtacatccaaaggctggccgatctcaaattgaatagacagttgaaaaaacaatgcacggcttttcgaaacgggctcaacagcgtcgttcctttgccgtggttgaaactattcagccacaaggagttacaagttattataggcggggatacccaagaaattgatctcagcgatttgtttgcacacactgtatacggaggtgaattcggaccggaccaccccactatagtactgttttggaagattttgcataaatttactgctgttcagaaaaaacagttactgaaatttgtgacaagctgctcaagaccaccgttattgggattcaaggaattgacaccgttattctgtattcagtcgtcagggtcggaaaacagaatgccatcagctagtacctgtctgaatttactgaagattccagtgattactgatgaagaaactctcagatataaactaacctcagctattgaacagcaggctggatttgaattatcgtaacttattgttttgactattgattagttattgagtgtatagttttgttctattttt

SEQ ID NO: 516 - DNA, 1511 bp, Leptinotarsa decemlineata
  Annotation=SCO-spondin (Fragment); Tribolium gene name from OrthoDB database=TC012794; Blast E-value Tribolium Gene vs. Leptinotarsa Unigene=4E-1; Blast E-value Tribolium Gene vs. Leptinotarsa Unigene=09
gatcatgaatgagttttgcggaaggtggttcttcgtctacgggattttgatacttgcacaatcgacggcttcttttatgctcggtgaccaatgcaatggtgactgggaatgtagagaggaaattattggatctatatgtcacagaggacgatgtgcctgtcagcctttttacgccagagtcaaccaaaccacgtgtttacagtctactctccttggatatgactgtttagtaccggaacaatgctctctgaaggtggccaatagtagctgtttggatggtgcatgtcgttgtattgatggtttcctgcagttccggaagcatacttgtcttggacctgcacgaccgggaaatgtctgttacagtaatgaacactgccgcttgtggaccgccgatagtcactgtgattttttgatcccaaacctatttggcagatgccagtgcaactctccattcaaacaagttggtgattcttgcgtcagatccgcattccaaagtgaacttaccactatagttgctgctactaccataacaagttcaccaaggacaggttcaactaccataagttcaatgacaagttcaactacaagttcttccactacgccacaactgacaacacgtcatcaaaataatgagatcgaaacaaatgttattgacgatgattcaactccacattcacctgtgtttcttagaactaattcaaagaaatctgtgacaaaaaagacaccatcttccattaccactacggaactacctttgactcaagaacctacctctgctccaatggactttacaactaagactaccatatcaagcagatcaaccacgatggaacctacatcagcttcacctatagaaactgtcaaaccttcaattacttcgactcagcctcctacaacaacaggtatacggactagagtggaaaatggcgacgaagctgtcagtttgggtttaccttgtgtaacagatattcagtgcagaatggccgatccttcttccagatgcttagagggcgtttgtgattgccttgtcagatcaaatgagaccagatcttgttcagcaagaaacagaggatgcattccaggaacttttcagtgtcgaagcaccggtacttgcataagctggtttttcgtatgtgatggaaggaaagattgtagtgatggttcagatgaagattgtaagcctcacaagtgtccggcagaagcattcaggtgtaaatcttcaggaaaatgtatctcaaaggctaatagatgtgatggcaccaaagactgctcccttggtgaagatgaagaaaaatgccatgcaacgggacgaaaaggttgcccacctgatacttttcaatgtagagatgggaaatgtttacctgaatatgaattctgcaatgctatcataggttgcagtgatggtagcgacgaacctccacatatttgcaaaggacgtgcgaggaggagaaggacagagtattgtcctcttaggtgcggtaacggaagatgcagatcaagtgctatagcat

SEQ ID NO: 517 - DNA, 694 bp, Leptinotarsa decemlineata
  Annotation=DNA polymerase epsilon catalytic subunit A; Tribolium gene name from OrthoDB database=TC009600; Blast E- value Tribolium Gene vs. Leptinotarsa Unigene=4E-99
cgtgtctctaagcagcatcgaatcctcaggtattatcaaattattcggtatcagatgcagtagctacatactacttgtatatgcaatatgtgcatccctttatatttgccctatgtactataattccttgcgagcctgatgaagttttacgtaaagggtcaggtacattatgcgaatccctccttatggtggaagccttccatggtaacataattttcccaaataaggaagaaacagaactgaataaattgactcatgatggacatgttcttgttcaggaaacttacgttgggggcatgtggaggctttagaatctggagtattcagagctgatattccttgtcggtttaggatagttcccgatgcaattgatagtcttattaatcagattttgaaaacgttggaacatgcaattgttgtggaggaggggattccaatggagtgtgtcacaaatttggaagaagtggccgaggaaatcaaagccaaactgacagctctcaaggaacaacctatgagattggaaaggcccttgatatatcatttggacgtaggcgccatgtatcctaatataatcctaaccaataggttacaaccctgtgccatggtcgacgaactatgtgcgcagcttgtgattataataacctggtgccatttgtcaacgcagtatggcatggatgatgagagaagaatatat

SEQ ID NO: 518 - DNA, 469 bp, Leptinotarsa decemlineata
  Annotation=Golgi SNAP receptor complex member; Tribolium gene name from OrthoDB database=TC015165; Blast E-value Tribolium Gene vs. Leptinotarsa Unigene=7E-73
gaagaaatgttccaaaataaaatggcgaccgtgttttcatacgaagatttgcgaaagcaagcgaggcaacttgaaaatgaaatcgacttgaaactggtggctttcagtaaattaggggcaggaataaatacaccacctagcaataatgatgatactgtaccattactatcagaggaagacaccttcgaaacgatgtcattggaaattgaacaattactcaataagctgatacttgtaaatgagagattgtcagagcaaccggtatcaggtgcagcgatgcttcatactattcagaggcataaggatattcttgcagatttatcccgtgaatactgtaaaactaatttattgagagaaagcagaaggcatagggaagatttgctcagaggttcagagacattcagaactgatggagttaataataggcgagatatgtatctgaaggaaaaccaacatattcataaaatta

SEQ ID NO: 519 - DNA, 1523 bp, Leptinotarsa decemlineata
  Annotation=Notchless; Tribolium gene name from OrthoDB database= TC004394; Blast E-value Tribolium Gene vs. Leptinotarsa Unigene= 0
gcctatttgaggttatgtttgaacaggttatgaatttctttaaacgagttgtattttaattcaattatttttaaaataaacgattatggacgcctcaaagactgaaatgctgtcgtgctgtttcaaatcagagagtggagaagtagctggtgacatgatggaattacctctagactgtactgttcaacaactcacactgatttgtaatgcaattttgcatcaggaggatcatatgccgtatttattctacgtcaataatactgaaataacagactccttacaaaaggctttgaacgtgtctgacctgaaaattgaaggagttgtagatataatttatcaacaacaggcaattttcaaagttcgtccagtgacaagatgtacaagttctatgccaggacatgctgaggcagtgatttcagtcagttttagtccagatggaaaacatttagcaagtggttctggagatactacagtcagattttgggacgttaatacacaaactccaagttttacctgtaaacagcatacaaactgggttttgtgtatagcatggtctccagatagtatgaaacttgcatcagcttgcaaggatggtaaaattaatatttgggatccatttactggaaaccagctaggaaaaacgatggtagggcataagcaatggattacaagtttgtgttgggaaccataccataagaatcccgaatgcaggctattggcaagctcgtcaaaagatggcgatattcgaatatggaatacggtattatgtaggacagaacttacgatttccggtcatacaaagtctgtaactgtagttaaatggggtggttcaggactcatttactcagcatctcaggatagaactgtcaaggtatggcgtgcaaaggatggggtgttatgtagaactctagatggacatgcccactgggttaatacgttagctttgaatacagattacattttgagaataggtgcttttgatcctgtcaaggactctgataaagatacaatagtgccagacaagaagaaatcacaagactttgctttgaagaggtattatggggtgacagaagccattggtgagagattagtatcaggttcagatgatttcaccctattcctttgggatccagagaaggacaggaaaccattggcaaggctaacaggtcatcaacaacttgtcaatgacgtcaaattttctccggatggtagactactggcctcagcttctttcgacaaatccataaaattgtgggattcaaaaacaggcaaattcatttgtacattccggggacacgttcaagctgtttatatggtttctttttctgctgattctcggctcatggtaagcggaagtgctgattctactttaaaactgtggaatttgaaaacgaaaaagctagagattgacttacctggtcatggtgaccagatttatgctgtagactggtctacagatggattgaaagttgcatcaggaggaaaagataaagtcttaaggttataggactaaaaattaaatt

SEQ ID NO: 520 - DNA, 1226 bp, Leptinotarsa decemlineata
  Annotation=P53 induced protein; Tribolium gene name from OrthoDB database=TC008317; Blast E-value Tribolium Gene vs. Leptinotarsa Unigene=2E-44
attgcaccacaattgaagaaggaaagataagcgatcagctgtttgcttgtgtttaaaatttgttttgaggtattcgtaatgcttgtaaatatttcgtagtttatcaattaaactaattatcgaaatatggctcactggaaggtaatgaaatcattatatcatttcctcaaaggactttttgagagttttagtggaattacatcaattttctatttgaaagatgatcaaataataaaacgggtctcccctacaagagccaatgctctgcgacaaaaacagaggcgtcctactacacctgtcaaacaggaaaaggaatcaaggagatcaaaagctatcaagagaatttcacaatgcgtgtttctggatggtctctgttttgtggtaatcattatcacccacgagtatatgttttcaccggtttggcaaatgatccttacatttttgaaatcttatgatcattgcatttatcttcggccatgttattttatatgctggcttctgggtgaaatattcagcattttgtggatcataccttttttcctgttgagcaaactgatcaacgtgtttttatttcaggatattgccgattgtgtttatacacctactagaggactgagtagatccaagagcaagcagatatcgatcccagatttaatatgttctttgggtgtccaaattttatttctgttgcaaattactttattgaattacaacccttttcctgctttgacgtacccttgttacgctttgaggatgtttctgacttgcctgttgtattctcagtacgcttttgaatataagtggatcaacatgggattgaatctatcagcaagactgaacttcatagaaaatgaatggccttatttttttggttttggcctaccaatgtttttgtgttcggaatatcctgaatctttttttgcaagctcgtttgtgttctcagtagtgttcccattcttcataataacaggaagtgcaggaaatcctccgtatgatacagggtacataacgttacccgttttctttcctactatgtacatgataaataggataatatcactatttagcaaatctgatactaatacacatcacactcaacagaatagatgaggtatattatttattttgtatagttgataatttttgaatgacatttttataaatattgactgatttgtatttttttttatttgattgggtaactttactgtaaattaaaatttttt

SEQ ID NO: 521 - DNA, 812 bp, Leptinotarsa decemlineata
  Annotation=PX domain-containing protein kinase-like protein; Tribolium gene name from OrthoDB database=TC008957; Blast E- value Tribolium Gene vs. Leptinotarsa Unigene=2E-141
tgtccctcagagttccgttcttgtgccccaatcttgctactaaaccacctatttcggtacaaatgctcagttcgatggcatgtatataagggtgctgaagttgacccaaactcttgaaaatagcatgcatttccttgtcatctaaatgtttatctggaccgtaatcagtccagctgccaaaaagttcctcctttgggatcgatttgcatttcagttggtagtaatgctttctcaagcgccaaccaatatcgtttatgggccccacaacttcccatcccacttctcctcgaagtgctagagaaacatgctgcagagccaactctccgaagggttggcagtagtttgctgggtctacaaatgaccgagctggtaaagaagataccaaaatcggattcatgaatacgttgtctaaatatttctgcaaaccctgctgtctctcactaataaaatgtgggtccatattaccaataagtttcttaggaggaaactcgatgggaattcctgaattttgcagagcattatgcaatttgaagaagtcattgtatcttttactgattttccaagtctggtccgaaaatggtcctctgtaaactctcacgatgaattctgtgtgtccattgacgtttttccaattttcaatcgtacattttataggctcagtgtcgtctagtaaaactttattgggtgtctgtctttcgaaaatagccattgaatgccgcacatttgctcactttcgagttgaaaatccatcaagaacaatttattttcaatttgcatttacgacttctacatcataaaatacattgtaaact

SEQ ID NO: 522 - DNA, 595 bp, Leptinotarsa decemlineata
  Annotation=DNA topoisomerase 3-alpha; Tribolium gene name from OrthoDB database=TC006688; Blast E-value Tribolium Gene vs. Leptinotarsa Unigene=1E-86
gtgttggatattgtcgagagctccacgagcccaccgaaactgttaaccgaagctgatttgatagctcttatggaaaagcatggaattggcacagatgccacccatgccgagcatattgataaaatcaaatctagggagtatgtaggtttgcacgagaatatgtactttgtcccaggtatactcggaatgggtttagtggaaggatacaacaatattggattggaggtatcattagcgaagcccgttttacgagcggaattcgaaaatgatttgaaattgatatgcgatggtttgaaaaatccagaagaagtgagacaagagcagatagcaaaatatcgagcagttttccagacggtgctgcaaaaattacagctcatcgatgaaagtctagcaaacagactagatgacagacctgttcccattgcaaatgatactgttagcaatgaggaatatagacctgctatgaaatgtcccaaatgtggcaacgatatggtgctgaggaataaaaaaatggaccgggtcaatttttatcctgtaatggttatccagaatgccgaaattcgatctggtttccaaccacagtggaaaagataga

SEQ ID NO: 523 - DNA, 5221 bp, Leptinotarsa decemlineata
  Annotation=Sprouty; Tribolium gene name from OrthoDB database= TC007446; Blast E-value Tribolium Gene vs. Leptinotarsa Unigene= 2E-52
gtgcttgtgttgtgtcaaaggactgttctaccattgcagcgaatcggacggtgacgaaagttgtgcggacgatccatgcggttgcggcgtgaaccgcagagcggccaggtggagctgcctggccgccctttcgtgcatcctaccctgtttgtggctctactggcctctgcgaggctgcaagagggcggtggaggcgtgctacgcgcgccattcgaggactggttgcagatgccgaccccccttaccgacgcccgaaaaaagattgttggactctagtcctgacttttagtgcgcgagtgtgctcgactgcccatgtgtacctaccactctaactttattacaatattaatttattttttgtaaataagtgtaatttctaactgtttataacaatgatattccgtgcttttttactgtgtgccctagatggaaaggtttaaaaactagtcctgacccaggcagtaggctttttgaaaaaagaggttttgatggaacattgattgtcagtaatttatggcttttttgctgttgaatacgaatttgaagattgtcaacaaccattttgatgctaaacatgttccactgtgagaaaattatcgtgaaggttaattctatatatgaaattgaagagaatgtaatttcgtttttgcatatctaacgtgattctcctatcaactatttaattgtgggagcgccgtcgaaaggttccagaagactattactcagacttgtcctttaggaacagttgaaaccagcagcctagtaccactggtttcaaccatattgtattgagttgaacgatcatcattgtgcagtaaaatatgaacaattttctgttgaagagaattcttgttcttgtcctggcaggaaataagtgcatcttggtcatctcgacaggtatctatctgtctaccaatgtcttttaaaagctttggaaagatgaagtttttccaggtactttgtcatttttttcaagctgtgaccttactactgatggagcacctcctcttcatgtagatattcactgaatggttgtgctgcaacaaataataaacaaaatttttgtcagcctttgcaaagatccccagctcttacaaaaatcctgcttaaattgtgaaagtctgaacattcttgcttaaaaaagtttgttttccatgtggttgaaacagaaaaattgtacccacgttgacacattttttcagttagacacgtgcagcttcaacgtagttgttttacctctgaggtgataaaaacgaggatgaggatctggaggatctagtataattttttcgcagatgtagatgaccacgcaggactatcgaaaaatatccataataataatgaaagctatcgatcaaaaagtgtgatgacactgaaagtatgaaaaatattaagctcctcacaactaaactgaagatttgagaaaaacctttagttagataagttgatcaattttatatagaatgaattttcatgtaatatttagtttcacaagcagagaaaccgtaacaatgtaattgttttcgttttctgcaaaaagatttatttgttgttgaactttttgatttcagactcgtattcaacattctaaaatactatcaatcaatcaatcaaaactgtaactcaatgttctttcatttgaaattttttgacgtctaatacctagattaacttggagaaacaaaaactgtttccaattctacctcttcatttacgctagttgagatgttttgacggagtatatgaactatcaaaatttgactataacatcaggtgtttgagatgaataaagattcattagcgaatgagtaaatgatcatggaacagactacgaagttgggaagaatagctcacagatctaacttgcatttcttgggagctgtgatgaatttctagaaacattactaatcaaagtttggactgaacagatccaaaaacttatgaaattgataacactcaaaaagtaatgaaagtcacccgagcaacatgaccaaattattatattatatgaacattgagttgatttctaaaggcacttttggagttattttgaactaagttgattggaagattcaaactgaaaacttaaacgttgattgatgcaaggtggatgttccttccttagaataatttatgtgaaaaactcagaaccagattcattgctaggttattttgaatcatagattttgccatgataccttcaccatgtttcaattaaatatggttaaagcgactcagaaaactactgttcaaataaatattacaaatttccgatattttcatgaaaacgacaaaataaatcaaaagctcatagtctatattggagccttgtttcatttattcaactcaaaactgtgtgtgatagttaaataataacacaaaaatattttttaggggagagggtagaccactatattcatatagagctattcatatagagtagctgaagctactctatttgaaaaatttgtctagaaaaaaaaaccaagatactagtttttgtttcttctgaaggttataggatgaatacgtcaaaaaaaaatcccattgtttatgtctcatgattgaagtggagcctatgaaaccgagaagtaccaatttcctagatttaaacttaaccccaaaaaatgtatttacgaatttttcaaaaaaaaagataccgatattctgaggttagttgataaacaaattctggtggaaaattttgattacatttatcaaacactacaatttagggacataactttggtacatttggacacgacaaccgagttgtggcttttctgagcacttaggtccaaggtagtggtggaaatgtggacagggatggaagaaaaaaagtgtgacgggcaccggtgaccagtattatctagtccagagctgtaagcagtcactttggttggtctattcggacctacaaaaaagtttaaccgataaaatcgaacagaaatatttgaattaagtttgttaatcgcttatttgcaaagaatcattgcaatgaacttgtactacgttttctaatcatttgcagattttcaattcttaaaattgaattttcttgtgttttcgtcttcgaccacgtaacactgtcttagcagaccgacttgaagtgactaaaagtatgagtgagactgaatgtttgttacgctcatgtgtgttgtctgttgtctttggaattatttgttgatttatttttgcaaattatttattttttatttatatacatacagggtaagaaaggatagaaacattgtaatgatcaaggtggtcgtttttatttatttcataacattctatactttcatctcgctctttgtttaactttttgtacagattgaatttcctatgacagaactggtcgaagtatattaaagatgggctacaggaaatgcgactgaggaaaattcatttttgaagacttcttatttcctgtatttttgaaagcattggtttgccgtacctatacatttccctgtaatgacacaaaaataattccagagaccttttggttagcatttttcaaataaagaaatgttagtactctttatctacgtatactacaacttacaaaacttacacatacgaaatatctgtatcgcaattttaatacaaaaatagatgcgattagatgaatgtaggaaaggatcactttgaacttcgcaacggtaacagcttgaagaataattccaaaaatataattattcagtttttccaaaactaaagactttcataaaacttttcgaatagtttcatttcgatatcaattgcaatccctagggatttcaagggtttccggttcgttctcaacatgatggagcgttcaatattagaacaccttactataaatcttaggcctacagtaatttaatttatatattgattatttcagaatttcacaaaatgactatatgattatactatatcacatctgtaatattgaccacactgtcatgtgaaactttttccaattagagaagttcagaatggcaagtctatttcaaaatacattgacgggttctgtgctaactacaccgacttttagttatgattgtcccacaaggaacttcaaatagcgatctctcacgttggagtcgcactttcgattctttttttttcatatggatattttaaatgaagaaacagtgtgccattttgtgctttcatttcatgaagaactattatctagtctgtatttattcagttacagaccgaaaattgatagttggttttatcttctgagttattaacgaaacggaccaatcattcgaaaacaacgacctctctgtataaatcgaaaacaaatctcaaaactatttttgttcgccttgttcgaaattacatgtgggtcttggcgataagaaaatgctgataaacttgcctagtcaatgtgatccttcataaacgcaatctaaggaatatttaaacatacttacatttatataaattatcgtacatcgatcttgaattttttatgaatcttcgacatttcgctatcactttttaaataacaatcgaggtgagcgtatttatttcaaatatgctctaacctcttgtatcaaggtcaaatacagagcgcctcgtcaaaaatgtggttgcattcagcgtaaaaaaagagtatttcatattattgaaattaaagagatacatagtaagtttgcatatgtatatttcgtaataatcggtgttgtaattttgttgacgttacattttttgacgggatgtcttcgacttattccaaaatacaaatgtttaggggcaacccgatataaatgtttaagtaactgtttatcaaaaacttataaaattatgttatttctcagctagattgcgcttttttgtaagtacggaaaaatagagttccgaaataatactgacatgtctgcaaatttatttttatacttttgacgaatctggtggtattccttcagaactctacataaaataggcttcattttttacaatgatgaaacttcatgttatgtcgatttagaaaatactgcatcaaatgcaatttgtaatcgaaactcttaattgaattttatcattgtgaatcgggttttatacggggtggtctagaaaaacatggttgtcttccatttgtccgggaaaatttactgtcctcggcagtttccaaattattttgattcctagccatttttggatcaccctgtatgatggagggaagtactctcactgagtgccaaatggcgcaaagctatat

SEQ ID NO: 524 - DNA, 675 bp, Leptinotarsa decemlineata
  Annotation=RFK protein (Fragment); Tribolium gene name from OrthoDB database=TC009022; Blast E-value Tribolium Gene vs. Leptinotarsa Unigene=9E-53
gtatttgttggaggttataactttaacactaggatgatgatgatgcagttttgaatagagagtttcaggatagtagctgaatgaagatgaaaaactaacaaaccagggagctgttcgaagagccgcaccggtgtgttgagtggaagcgcaaactcctgaacattatctgcccacagtggcgtaccatttcaatttcgaccggtttcgaaatatctgcagaaggatcatgggtttgcctcattttgccaagggagaagttatcaagggattcggacgaggttcgaaggaattggggtgcccgacggccaattttcctatggatgttgtgcacaatttaccagcggacttggacactggcgtttattttgggttcgcttccgtggatcggggcgaagttcataaaatggtgatgagtattggatggaatcctttttataaaaacgacgttaaatcaatggagacacatattctgaatacttatgatgaggatttttatggaaaggaattgcgggtggccatgttgggatttcttaggcaagaaagaaattttaaatctttggatgagttgattggagccattcaaggagatatccgacaggctagagagaagttggatgagccagattttataaagtacaagacgcatccttttttcaaagaatgactgttatattt

SEQ ID NO: 525 - DNA, 2060 bp, Leptinotarsa decemlineata
  Annotation=Glycylpeptide N-tetradecanoyltransferase 2; Tribolium gene name from OrthoDB database=TC015649; Blast E- value Tribolium Gene vs. Leptinotarsa Unigene=0
gaatacagattacttcaaactgggaagtagtttactatttactagaaacatcgaatcggacattggtcatactgaaaatgtcggaaaaaaatgagaaaaatatatcagaaaatgccaatgaagtagatggaaatattgatggtataattcaaactaaaagttccaagaaacgcaacaaaaataaaaaaagacaaaatgaagttgaggaagagattaaggataacaacggcgaggttgttcagatcgaaaatggaatggtgtccaatttaacaacacctcttaataccatatctattaaagaattgaaggctgcgatggaagtgttctctttgtctcagaaaccagcaaagacttctgaagatgctttgaagaaatcctatcagttctggaatacacaacctgtgcctaaaatggatgaaaaaataacagtaaatgaagccatagaaccagataaagagttatcagaaataagatcggaaccctatactttaccagagggatttatgtgggatacccttaatctagatgaaccacttgtactgaaggaattatatacattattgaatgaaaattatgttgaagatgatgattgtatgttcagatttgattatcaacctgaatttttgaaatgggctcttcaacctcctggatggaaaaaggattggcattgcggtgtgagagtagttaaaagtggaagattggtaggattcatatctgctattccagcaacactcaatatttatcagaagacccagcaaatggttgaaatcaattttttatgtgtacacaagaaacttcgttctaagcgagtagctcccgtattgataagagaaataacacgaagggtacacctgactggtttatttcaagctgtttatactgcaggtattgtgctgcccaagccggttagtacttgtacgtactggcataggtccctgaatcccaaaaagttgatagaagtgaaattttcacatctctcaagaaatatgaccatgcaaaggacattaaaactgtacaaattgccagataaacctaaaactcctgggtttaggaaaatgaccgcagcagatgtaccaaaagctcataagctgcttgtagagtatttagctcgttttgatttagcaccacttttcaatgaagaggacttcatacattggttcatgccaaggcccaacatagtggatagctttgtcgtcgaagcagatggtgaaataactgattttgttagttactactctcttccatcgtcagtgatgcaccatccagtgcacaaaaacctcaaagcagcatactccttctataatgtgtccaagggaactccttgggttcccttaatgacagatgctctgatatctgctagacaattaaactacgatgttttcaatgctctggatttaatggataactctgaatttttgttacaactcaagtttggcataggtgatggtaaattacagtactatttgtataattggaaatgccccagtatgatgccttgcaatgttggtttagttttacaatagtgagaaatcaaatataaaaaaattatttgtggaaaactagacttattatttaacgttttgtttctgaacaccaaaatttatattcaagccgtttttaaaaaaatgtatggtaaaatgcttattcttagatagataataaatttccagagtgaagtgactgaatcaaatgcattggcttcaaaaactttggtattgggttgtctaggtactagtcaaaacacaaattttgaatgaaaaaatcaattcaaatatcatttgaatttataatgattccttgtgatcctctcaaatcatattcaaatatgttctgattattgttttcatatatattgtgagcattacaatactgaagttttgtcaatttgctaagagtttcattgggaataaatgtattctgacaacaaatatcttgtttcagatttatcccataaactgaatgttcaatcgttctaaataatcaaatattattttaggggtttatttgttatttactgttaccctacacaatagatttcatattaaattttcttaatatta

SEQ ID NO: 526 - DNA, 2037 bp, Leptinotarsa decemlineata
  Annotation=Ventral vein lacking; Tribolium gene name from OrthoDB database=TC003196; Blast E-value Tribolium Gene vs. Leptinotarsa Unigene=6E-42
taaaataataaatatacaaatgaaataaatcctcgatgaaattttcaatagttacagtacggatccaagaaaaattttaaagttcaacttgacgacgtttgaacagaaataataatgatataattattataacaacataagaacaactttcatatatacgacattctgtacattaaaaacttacagttaatttgtatatcgacaaccgttccggtataggtatttaagtataaatcacgatttttctactattggaccggtacttgaaatctttatatacaacgttgcatatttatcctaaaataatatattacagtgccccttcttccaggcatctttatcactcttcttatttacaaataatatacagataaaacgtacgcggtcctctagtctaaaggtactcactcgcacttcacagggcgtatgatttattgttcttactccaccgaggacctccacaacgacatacggggggaaacacagtataacccatcctggctttgaggtagcgtgaaaaggagtttcaagagccgacggaaatcgatcgcgcgtgtcttaggatatatcactagccgttgtcactgttgtgcagcaaggaggcccagtgggctggatgctagtgggccgtcaactggtggcccatgctttggggggacaacatcggcgggctgtgggagtgcgaatgctgtcccatgggcgacccgtgcatgtccgggtggtggccgtagccggggtgtatgtggctacctggaggcataccttccatcatgtcgcctcccaaggtgttaggaggcgtcatccgcttttctttttgcctcctgttgcagaaccacactcgcacgacttccttctctaattgcaaactgtccgcgagggaggttatttcttgagcagagggtttcggttgcttgtgaaaatgctgttctagcgcacccttcacggatacttctatgctcgtgcgtttttttctctttctgccctgcgccgcgatcttgtctatggacgtcggcgagcccgttgtcgagtccgcttcctcgagccacttttgcaaaagaggtttcaacttgcacatgtttttgaagctcagctgcagcgcttcgaacctacatattgtggtctgtgagaaaacgttgccatacaatgtccccagtgctagaccgacatcagcctgcgtgaagccaagcttgattcgtcgttgtttgaattgtttggcaaaggcctctagatcgtcgctcgtgggcgtttcgtcttcgcctccgctcacgtctctctccgaatgctggggatgatgcggactctgcatgtcccggtgcaacgagtggtgcaattggggcggctggtggtgagcgagcatcccgttcatcgccgcgtggtattgctgaagaggagacgcggtacctccggggttgtagtgggccgaagacacgtgtccgtgccaaccgtgtggtgagcccatactctgttgctgttgtctctggtggtgcatcatctcgctctgttgcgtcaacggtttcacgtcttggtgcgggtggtgatgatgcgcgtgatgcatacccgccatggaagctgcccagggatctccgtgtggtatacccacccaagggtttgccgatagtgaaacagctgctgcatgtccgctgggagagggcgaactcgctatatggtgatgatggttgtgttgaggcaaatacttcatctcgctcgcgtcggcagccgacctcggagaggcattcgaatgatatcctcctacaatattcattccaacaacgttaccgtccagatctgtcgttaccgcactactcgcttgcaagtatgtcgtggccgccatgccctgtaagggccgctcgtccacactgtcctcgtgttggaacactttgtgcactagttttcacactaaaaatcaatttttatcactgtttatagaatgcactttcggcgacgttattgaacaattgtctttactacagtccgtcgcgcaataacgtgtttggaggtaaattattggtgacaaatcaaaatatgcgttatgcatat

SEQ ID NO: 527 - DNA, 1938 bp, Leptinotarsa decemlineata
  Annotation=CG7120; Tribolium gene name from OrthoDB database= TC012794; Blast E-value Tribolium Gene vs. Leptinotarsa Unigene= 4E-123
atcaaatatctaatggcactttttatacatccatcacagaaacaatattttctcaaggtaccatttttgatgcaacgagttacctcggcgtacctatctagtcggcttatgtcgccgagcagccggaattcatcaactccattcctcgaatggacctccacggtggcctcaaaaatcgctttggggtctgtcgcaactatcaccaagaagtatcgaacagtttcatttcggtcattgacgtaagaatcggacatgccagctgatttaattttcttcacggcaaaattggcgcagaaccacttttcttcgaaggagttttttaatttgttgacctcgtcaacgataaactctccgatcaatctcactaaagtaccgttggaatttacgtagtggtgtccgttgcaagtgcaccaatgttggtctatcgagacgtcatggcacgttcgattctctggcagttcctggaatagagagcggcaattcgggcaaccatgacttcttgcggccacgtagctactgttaccgatttccaggatgtcctggaaagtgttgaacacgtcatacggtgtagttagtctctccgtattcactagaaagttgctgtacttctctggaaaacgcttcctgaaatcatctggaatataaatatatatgaacggaagcctttcttccagccaacccgagtgggtgtacctaatatccccgaatctgaagccgtggtcgctgaaaaccagcacaattgtgttgtgcaaggacgagactaggtcaccgtcgctcaaaaaacccagcacagcttcatccatggcagaaggtagattcacattatcgtggctgaagctgttcatccaaaacaacccgaaattaggcacttgtttaaagctaacaacgaaatctttggcaatattcaacatcctttctgcagaagtctccggtccggaacagaacgtcatatcatacctcttcttcgtaggcaaagtttccgatgcaagaaagtaggggtggtagtagaaatccgtgggtggatcttgaaaacctggcctgtcgtaattgaatgtgctgattgcgcattcgtcctcggcatacgctgtggtgtaccccgaggctcggaacgcgtcccagacgaagcggcagtggttcattttcactttcgtggagcagaaagtctgcagttgcgctaccgagtatccagtcaggagggccatgagattaggaaacgtgttgtcgccaattttgttgtagcctttcagacttatatagttttgattcaagtattggtaagtttttggcattgtacgtctcaaattcgattttgacatactgtctatgccgactagtaatatactgtatttcttctcactggaaacgtcgggcacctttcttggggtcggtaaagttgtggcatggacatttgtgtaaacgtttttcaatatgttggagcatacgaccttgacgaacgggaaagtgaggttaacctctttttggattggtgtgcatggggtgagctttatttcattgtcgactgccttgacgtaattaattcttgttatgttcgaataacaacaagtgattttcattgaactatactcagacaaaaggctcgaatttattcttaaccggaccattccattacttttatcgatgtacgtcaatagtcccaatttggtacaaggttcatatttttcctgggaaatgtattgtataatatcttcgctgaacgggtcggcatctggtattcggcatttggaagtatttattaaatagttgatattttgtggtatttgtgtcattatcacttgtcctatccgaatcatttcagtcttctgccaatgacctgtgtgggccatatataaaaaaaatcacagcaatgataatcaagatgaggtatttttcaaatgtcctccggaaataaaatttgagtctatcccgaaggttcttctg

SEQ ID NO: 528 - DNA, 482 bp, Leptinotarsa decemlineata
  Annotation=Potassium voltage-gated channel subfamily H member; Tribolium gene name from OrthoDB database=TC015503; Blast E- value Tribolium Gene vs. Leptinotarsa Unigene=3E-93
gtctgagggcactttctttaaagttcaaaacgactcacgccccgcctggtgatacgctagtacatagaggagacgtgctgacttcgctctacttcatatcaagaggttctatagagattttaagagatgatattgttatggcaattttaggtaaatttgatatattcggagaaaatccatgtttacatcccacattgggaaagtcggcgtgtaacgttcgagccctgacctactgtgatctacataaaattcatagggacgatttgttagacgttttggagctctatccagagttctacagccactttttgaataatttagaaattacttttaatttaagagatgatgatcaggccggggttgttccaaggagatctttttatccgaaggataaagaaaccaggtatttcaggggagttccttctgccagatcgaatggcatttccagtcgaggaaattccatgaatggcaggcaagaatct

SEQ ID NO: 529 - DNA, 1380 bp, Leptinotarsa decemlineata
  Annotation=Retrograde Golgi transport protein RGP1-like protein; Tribolium gene name from OrthoDB database=TC009939; Blast E-value Tribolium Gene vs. Leptinotarsa Unigene=0
tattttgaacctttttattgatgaatgtcacttgtaacatataaatataaaaataaaaacattttcaaatctacaacaattatctaacgaataataagtttatgtttattactagcatgcaccccttgggccacatgcataggtgtagttgagtataatcttattggcaaactccacaccatcgtttctataggtatttcagaaggtgcctgccaattagtgtcctctagcgatggggtacttaggcctttgtgggtactcgtcacaaattcaaaatgtagacgccatttcaaacttactaactttgtactaaatgcaggggtcacatggagtggtataggaaggattagctgagtatacttgtatcctaaacaaacttcgtgatgattgctaaaggtaatcacccgcacttgtttggaattttcgttgtgcacatcaatggtagtttcttcttcgcactgaagggagacggaaaactgaacgcattcgacagtagctactgtgaaatcaaaagttcctataatgtcttctcctaatttatatgcaggtttgaataagcaaaaccttgccacttttccccagaggtttgtgatcatataaaaatttggattgcgtcttgcagtgacattttgcaggctctgtagagctaaatcaagaggtttttccttttgtctgatttctaagaaaggattagctggggttaattcctctgttgtttcattacaaagatcactggcttcactcaatagagcctcacagaggggtaaaactctgatgggtatcctcaacaatttcactggactatttacacgttgagttcctatggcaattttatatgaatattttacaagttgtcctctgtaagaaggaggagaatcacttggaattttttctctataaataaatgtttttgactgtcctggagacagcctcaaatcacaaaacagtattttgggtctagtagcaatctcagaagtcccattttcatgaaggcctgtacctaaggaagtgtcagcaaaagtggggctcaacttttctttttcatgagtcacttttgaatctgtggaacactgacacaagatttgggctgaagcccatgctaaagtctcaaatgcgtccgtaaaactctgagacaccatatgattaggagaaggtggatgaatgaaagttatactgcattctactatttctccagaaaggaatacatggccgtgaggaagtttggctatcacttctatcatgatatgtttttttaaattataaaaatggtttttcttcaaaacgccttagtttatttgactcccgaaaaactaataggtaatatattaaatatatgaaaaaaaacttaatattgacagtaagagcagtgtgaaattggct

SEQ ID NO: 530 - DNA, 867 bp, Leptinotarsa decemlineata
  Annotation=Mitochondrial ribosomal protein, L46,; Tribolium gene name from OrthoDB database=TC001144; Blast E-value Tribolium Gene vs. Leptinotarsa Unigene=8E-56
gtcaagcagacactgacatacactagcactatacttaggtggcaagattttctccaattcatttttgtccaaccaccgaaaatccaagttcttttgagatatatggccgttcaggtacctcgcaaaatatatgaaaaccttggctccaactatatctgtttctttcctaagacttgctgggtacttatatttataaaagccacatggagcattgccgaaaatctgtgccttcacttcagaacccacagtttgtttcaaagtgcgttcagcagtctgtcttaaagtttccccatcctgtctcaaatcttgtgggagcatataaaaatacttgtcaccaatcttctggttcagaacaaatactaaactcttatccaattttctagaaagggatttcaaatcatttttcttatcagcttcagttgttgtactagcaggtttgaattttgaagcctcttcactccataggtccatcaagtcctgtgccgtctgtttcaaattactgtccatatcatctaagtctccgcctccttcaatatttcaagttgctttaagtcctcttcatgccgaagttcgatattcgacttcagacttttctctagttcaacttctgataagagttgtttgtattctctttcaatttcattcatagccggtgtaatgactggctttcgttccaggcaaacagcagtgagcaaatcccatttttcagcggtggcaaaggtggtggaactttgtgctctgaataaatcacgaaaggctatcgaaagattcaaaaccgcgaatttctgatcatttctcttcagtaactatttaaattttgaattggtttgaattcggaatctcaactttcaagttagatctgtcgtc

SEQ ID NO: 531 - DNA, 1293 bp, Leptinotarsa decemlineata
  Annotation=Deoxyhypusine hydroxylase; Tribolium gene name from OrthoDB database=TC006746; Blast E-value Tribolium Gene vs. Leptinotarsa Unigene=1E-1; Blast E-value Tribolium Gene vs. Leptinotarsa Unigene=06
ttacaattgtgatgccttatgtatttcaccagtttggtattttgatatttattactagatatgtttatgtaaagttcaatataaagactagttatgagtgctttttctaaaaaataatttcatttcaaactatttctcttcttaccacgtttcatggttacagaaattccattaacaacgttattctttataatgacaggttggtagaaaagcctactcagactgcaagactgtagtagtctttcataaaaaaaaatccatttttttattgactccaatatttcaacgagagccaaaatggtatgggttttattaaaatttaaagaattttcatcgtttattaaaatttttcacttagagcattagcatactggaattctgggctattttcgtattcacacatatccagcgctattacacaactttctttgacaactctcttttcatcattcacataactgttcagaatcctagtacattcctcattagcaattgctcctaatgcttctgcacattcatgtcgaaccatttcattttcagcttcatcttccaaagattctttcagataaggtatactgtgttcatcctggagctgtcctaaaacaaatgctacttcatgcctaaaaagagcacttccagacttcaaagccgcccctaatgcttcaactgcttctatagatttcagatttctcaatgaaaacatagctctgtacctttcaaaaagggtactattttcatcaattaatatatcttttagctcgtcaacatttttaattcagtgggaggtgctggatctacagaattataaggattttctgaattgctctggtcattgtttttctcaagccattttattctttctaaagcaagttgacatgtttccgctacctcaactacttcatcgtttttgtacttctcaagaatatctatactctgaggactgccaatggctcctagggcttcagcagcttcatgtcgaaccataggttcctgtgtaacatcttctaaaactttaaccaatattggattggcattctcgtcctgcatttgtcctaaacaatatgccagttcatgtttcaataaaactgattcatcagaaaaacatttttctatacatccaatagagtcatttccgcctagatttcgcaaggtgaataaagctcgaaacctttctttgagtggtcttttagggtcattcaggacctttcctatatccactatttgatttttagtagctaaaaccataattcacaattttcacgtaagtagcaagttctggtaagtgataaatgt

SEQ ID NO: 532 - DNA, 823 bp, Leptinotarsa decemlineata
  Annotation=NADH dehydrogenase; Tribolium gene name from OrthoDB database=TC006357; Blast E-value Tribolium Gene vs. Leptinotarsa Unigene=6E-95
gcttgtcaattttttttgtacatctgatatttcgacatttgtcaaaggacaactggttcagtctttttggtaattcaaaaaggcatttcatattttgaaagtaattcaaaatgccagaaataactcctagaaatattgttgaaagatttttctgcgctgttggaaatgttttggacgctcctgcagtttgggtcagagaaaaaattgtggagcccaatcagaagagttatccttggtatcaccagaagtttcgaagagttccaaccattgacgagtgctatactgatgatgcagtttgcatatatgaagctaattgtcaatacaaaagagacaagcaagtcgattcagaaatcttgactatcctccgagaaagatttgaagcttgttcaatgtatgaggctccagatcacttagaaaagtgtactccactttttcgacaatatgaagaagcaactactaattggttcatcaaatatggagatttaggggcttatcataatgctacaagcgcctacatgaaacaaaaacatagaatgatttgggaacgtagacatggcccagttggtactggaatgaaggaatctgctccagcagaataggtgaaaaacatattactaattactgcaagttgtgtacattttcatttgttatcaaaaccaacaacaaaaaggtaacgtcttataactgaacggaacaaatgagttcgattcaaagacagaaatatagaatttcagattataaatgtaaatgaccctcttgtcagtagatgagatcactttgtttcatgatactgttttctgtagataatttgtttgtaatatag

SEQ ID NO: 533 - DNA, 2718 bp, Leptinotarsa decemlineata
  Annotation=Transmembrane 9 superfamily protein member 4; Tribolium gene name from OrthoDB database=TC013205; Blast E- value Tribolium Gene vs. Leptinotarsa Unigene=0
ggatgccaatctcaataattttgattgtcaaactgtcaaaaattttatatagtctaatatctgacaaatgcattttaggtaaaaaaaaatggattttcgcattatttaaccaataaagttccgaataatatacaatagttttgccctattccgtcaccctggtagtaactagtaccctgcaagatgtatcatgggaattgtgttttccttgtccaaataatttttttaacatgcttgtcgccaagttaccaattctacgtgccaggaatggctccaacagatttcaaaaaaggagacccgatagaagtaaaagctgtgaagatgactagtatcaacacccttttgccctacgaatattactccttgcccttttgcctgccgaaagggggatctgacgcaatccattataaatcggagaatttaggagaagtgttaaggggtgatagaatcgtgaacactccttacattgtgaaaatggccgaacaaagtccctgcgctctgttgtgtaattcacccgacaagcccatacattggggtgttagcgagtcccaaaatgttgtagacaggatacagcacgagtactttgttcatttgttagtagacaatctgcctgcagcaacgcaaaccatcaactcagactccagtgaaatccaatttgagcatggttaccgattaggaaatacagtcggtgacagaagtttcataaacaatcacttgaaactaacgttgctttatcacactccagaaccaaacatatatcgggtggtaggtttccgagcaactgcaaaatctgtccacatggatgaattgaaatttgatggaaaaacatgctcatttccatccaaacccagaccgcaggtggttgatcccgtttcaggcaccaaattattctttacctatgaagtggaatgggaagagtcttcggtcagttgggcatcaagatgggacacctatttagccatgagcgatgctcagatacattggttttcaattataaactccattgtggtgatttttttcttagcaggtattttaactatgataatggtgaggactttgagacgggacatagctaaatataacgcagatgaaagttatgacgaagctattgaagaaactgggtggaaactagtgcatggagatgtttttagaccaccaaaaaactctaggttatttgctgctctgataggatctggaattcagattttcctgatgtcattgataactatttttttcgctatgttgggtatgctgtctccagcatctagaggagctctcacaactgcagctatcaccttttatatgattcatggggcagtagcagggtatttgtcggcccgtctctataaaactatgaaaggacgtgaatggaagagagcagccttcctcactgctgtcctctaccccgcagtgctaggccttacttgcttcttcctcaatttcttcatctggggcaaagcgagcagcggggcagttcccttctccgctatgatctctcttctgctgatgtgggtattcatatccttgcctttggtctatctcggctactattttggatacaggaagcagccgtaccagcatcctgtcaggaccaaccagatcccgaggcaggtaccggagcagcattggtatatgaatccgattttgtgtaccctgatggcaggcattctacccttcggagcagtattcatcgagctcttcttcatattcaccgccatatgggagaatcagttctactacttattcggctttctctttctggtatttgtcattctggtgatatcgtgctcacaaatctccatcgtcatggtttacttccaattgtgcggagaggactaccactggtggtggaggagctttatagtgtcagggggcagcgccctctatattcttggatactcagttttctacttcatgacaaaacttgaaattaccgaattcatcccaacgttgttgtacatcggctatacgggcctgatggtgttcactttctggttgttgacgggaaccattggattctttgcagcatatgcatttgttcgcaaaatctatgcagctgttaaaatcgactaggttatttttgagtatctaagttaatgtatgggtgagatgaaggacaaagattacttttgatcattttcagcaacgaatcgacttgtgtgagttttgtgaatgtttcttttggagttgtttggattccgggtgattggaatgcacagggtgacctgtggagtgaacgaaactctcgttgacttaatttatttatcagctttagttttgctagagtgcacatttgtttttcaagagagcagacatatatatggtgtttctttagttaattttgaccattgagaaaatttggatcgaagatttattagaaagattgggaaactataaatttcatttttgtgtgtattaattattctacaacgtttaaaacgatcgcaaatatttgtacaaaaatacttaaaactctcttgaacatttttattcccctttcaactaaaataccgtgattttgaatacaaatttaaaaatgttatttttatagttgcttgttactgttttctgccaaactgattaagtgaatctttttgattttaatttattaagtgcatgttgtattgactttaattcttttataggtctattgaaaatatataattcactattaccactgtacatatttatgaaagtaaagtaataaattcctttagt

SEQ ID NO: 534 - DNA, 997 bp, Leptinotarsa decemlineata
  Annotation=Cuticular protein analogous to peritrophins 1-G; Tribolium gene name from OrthoDB database=TC008877; Blast E- value Tribolium Gene vs. Leptinotarsa Unigene=6E-75
gtggatattgatttcagtaacaaaatgaatatacctttaacgatatgctgcttcgtgttagccacagtaagttgtttgccagagcctacccaaatcccaggatacacgcagctgtctcaacagcagataagtcatcttcagaacaggggttttggttcgacgaaaagaacgtttgttccaacagtagcctatagggaagaagatgatgaattgtatgacgacgatatcgatagcgaggcagaatccagccaagatagagttccaacttacgttaaccagaattatccgataccagtaagggcaactgtacagccaaatttaaattaccccattccagtaagagccgctgtaagcaaggctggctatgttgcagctactccaaaatatgataggagacttcaacagcaacaatatacccgtggggaagagttagaggctaacaaattggaagaagagaaagaagaggaagaaccagataggttgagtcaactacttccacagtctagattccaatgtaatggaaaaaatacaggttattatgccgatgaggaactaggttgcgaagtattccactattgtcaagccaacgcgaaacattcctggatttgtccagaaggatttactttccatcaggtccatttgatatgtatgccacctggcggtgataatatctgcgaaaaatcatccgactatcattttgtcaacgagtacttgtacaaaccagtgaatttggaagaatatcagcacaaaccaaacataactctgaggtattctgacaggtattacccagaacagtaccgttccagatacgaagaagacgacgagactccagtccatcatcaacattcggttcgcgtaacatctcaaccccgtcaacaagtttcaccaacaacattgagatcacattccgtatcccatggacagatattcagatctcccgaagaaataaatctgtctcttcagcaaagaaggccgcctcaacaacattacgttaatg

SEQ ID NO: 535 - DNA, 983 bp, Leptinotarsa decemlineata
  Annotation=Putative virus-induced protein; Tribolium gene name from OrthoDB database=TC008024; Blast E-value Tribolium Gene vs. Leptinotarsa Unigene=5E-53
gaagaaaatcatcataggtatacaagctcgccactgaaaaccgagcgagacgcaaaacaggaaacccaaacacgacttttgacgacgcctgcagtaaaaaccagtgctgcgcttatattcagcaggaatctaatagaagcaagagcgtatgaagctaggagcgtttgcgaaacattgaatattattcgctgtcagagtgactttttgcaagatgaaagtgttagttttgttagcgtgtttattaggctgtatttcgatcggtgcagcattgccagccgcaaagctcaatgatgacgtggaaatactccctcctaaacccaatatctatggagatcaaccaattatcgacaccggtgtcatcggagaaggctcattctattccaatccattcggagggtttttggatggtatagaaggcatgatggcaagacttagacaacaaatggaagccatttttagacgctttcccggaattcgtgctggtaattcttcggacgaagctttcgatttcccatcctttgaagaaggcctgcctgtattgcctaatttcccatcgctgaatccaattgatttaggaaaaggaaacaccacttcaattaccaaggtcattgatggacacaaagtcatcatcaacgaaacggaatataagaaagaagatgaatttggaggatctttcttcaaagtacgtatcatcgacgtccaaccggatgaggaaggtttgacaaccgacaaaaatgctgaaggaatcccaactggatcagatgccccccaagatacggaatccgtggagagtagtatagaaaatgaaattcccaaggataaagaggacccttcccctgttcctgagaaactcagaacggcctagagatcactggcgtatggggttgtggaaaaaggtcttcatcatcattattgggaattacatattctttattgtgttaaattttagagtggatgttatattattattcttatacacatct

SEQ ID NO: 536 - DNA, 2542 bp, Leptinotarsa decemlineata
  Annotation=Serine/threonine-protein kinase MST4; Tribolium gene name from OrthoDB database=TC014767; Blast E-value Tribolium Gene vs. Leptinotarsa Unigene=0
atagtataactatttattaatagatatttacacatctaaaaaaatacattgcaggaaaaaatatgatcttaaatggtacaatatagttcaatctagatatacatatatacaatatatccaatgaggacatggcattacttccaacttatttatttaaaaaataaccagtggtcaacaataaaatctgtataaggaaaactcgaaatatctacgtggggcgatctcaatctccaagccaagaactgaacgccctttccgaaacggtgaaacggcatgtatttgcatcagtttaaccctaggtgtgtgttttgtgtgtgggtgtgtcaatgctcacttaaatttaccagtaataagctcaagagatatacgatattgtcatgtatcggtaaatagtaacgatccgaagagaaacggtaggagaaaaagtgttttgttatatttaatcgacggactatccgtgccggccacctccttctatatatctacagagtatccctcaccaccttatccaacacccctttgagcctctgttccgtgatggatggcgccagtttctgtaccagctcgcagatgaacatctcgctgatgccgggactcgtcctctctgctatttcgaacgcgctctccaaatcctcgatggcgtcgttagatttgtgcgacgcttccgccgatcttccgttgtactggtgttttttctgtaactctgttattattggataaataaaccctccaagcgccggaggcgatcgactttcaattttcccgctgtacgaatgctccctagacatcgacttcctgttctgtttcttatccgccgtcctggcggattcgctcgctcctcgatggtccagcggactcaactcgcgcgaaatcctcttctctttttctttaacttcgcgttcgcgatccctgtctctatctcgatccctatctcgttccctttcccgttcggaatccttttctcgatcccggtccttgtcctttctgttgtccaactgagtttgggcgaccgacgaagatttggaagaaggcgttgctttgtctgacctatagtgattgagattggagtccttgggtggcgacttgcccagcgttggccccgctgaaccgttttgggccctgttgatgatggggttcattgagggcatgtcctccaacggtagtttcatgttgcctttcacagtcattatccaaggatcgtccaagtcgccgtcttgttttgcttcttccgaatctgagttttcggattcagtttcgctctcctcgttcctcgtacacctccacttcttgtatctatcaatcaagtctatcagataagagtttttcttggccttccttatgaatggatacttcaggagttctttagcagtgggcctgttttcgggatccttgttcaagcaagcctccacgaaatccttgaactgtttgctgtagctgccggtcagttgcggaggattgtttttaggaatcagaaagaggacccgcatgggatgtagttctgaattgggtggttcgcccttggccagttcgatggcagtgatccccaagctccatatgtccgctttggaatcgtacgcagactgtttgataacttcgggtgccatccagaaaggggtgccgacaaaagtgtttctcttactcgtcgtattggttagttgaccagcgacaccaaaatcagcgagtttgacatcacccatctcgctcaggagcacgttagcagctttgatgtctctgtgcaactttctctcgctatgcaaatagtccagacccttcagaacctccctgaggatgattgcgatgtgcatctcttcgaaattcccggctttcatcagatccagcgccgatcccccgcccagatattccatgatgatccacagcttcgtacccttgagatacgatccgtaatacttcgtaacaaacggactgtcgcactgcgacagcaccatgatttcctgttgaatgtcttcgatttcatcttccgcctcttccaaatcgattattttgatagcaaccacttgagtcgtcctgttatcgatacctttgaatacttctccgaaagatcctttgccgatacgttcctgcttcgtgaatatcagctcgggatcgactttctcattaaaggccatttctgaaggtaggcagttcgatggcctttcacaaaaacaactgtttctgggaggtccaagtcggtcctcggaatccaaaaaatccactaatcgaattcgggatatggaacagtcctcgatatctgcttcccgttagcagattcgtaagttcacacaaaacattttagttcccgttggtaaacaacaaaaaatttacattcctcaggtgtgcgaggtgaggcaaccttttcacgacgagacgacggattttgaggactctggagggtgacacgaaaggaaacggtcgaaaacactgcccactgtcgcgaaaattaccaaatttgacgaaattttcactgtttttcagtaacatctgacaactttacaattgtcagaagaagccatattgagattttgacaagacgacgatgacagcc

SEQ ID NO: 537 - DNA, 1772 bp, Leptinotarsa decemlineata
  Annotation=Ran-binding protein 3; Tribolium gene name from OrthoDB database=TC012664; Blast E-value Tribolium Gene vs. Leptinotarsa Unigene=6E-118
ggcaacatttaataaattattacaaaagatggcggaaccaaataaaagtaatggtgatggaatagttaaaccagcagtattgcatccacccattattatgaaggtggatagtcctgaagggccaaatggaaatgaaattgaagacaatgaaaagaatacaaatgaccacaacaaagaagatttcaaagtgtgtagtccctttaggtcttccataacgagtgcccccaatccgtttgcatcatctcagaatagaatatcaaaaggtattctaaaaccaccacagttcaacttgaatagttcaactggacccagtagcaagcccttcgttctgaaaccaagtcaacttaatcctttggccaaaaggtctgataatagtgataaaattaacagtgataaaagtgataacagtgataaaaacaatcaagttaatggtgaaacaccaaaatttgttcccctaattgttcccgaaagtaaaatccaacaacaaactgttataccaaatccctcgaaacactctccttcaccacccaacagtgtttccaatagtacttttgtatttggagaaaatttacaagaaagagtttacgctggagaaaataaacaggaggaaccaaaagcttcaacaagtttgggttccaatggcacatcagaaatgctttttagtagtgctatcaaaagcgacatcaaaactgatggtatcacaaaagaaaaggaagtgaaatctttgagtgaatcagctagagaatatgaagaaacgtcgagggcaaataaaagaaaatatgaagaagtagaagtaataactggtgaagaagatgaaaataatattttgaaaatatcatgtaaattattttcttttgacaaagtttcaagcagttggcaagaacgaggaagaggtacacttaggttgaatgattttgaaaatgatgaccatataggaagtagactagtcttccggactacaggaagtttgagggttatactcaatactaagatttgggctgaaatggttgttgataaagcgagtgacaaaagcattaggataactgctctggatgctaatggagaagttaaagtttttctcataatgagtaccattgaagattccagtaaattatataaccatcttcttcctcgtctagaaagggaaatattctcacaaaaacataaaaaggcacatataccaaccaagagtgattcgaagagcaactaacttgggacagcttttgaatatacatacaaaaattcatagcagcgttttgtgattggtagattattctatcaatggtaaattatgtgttggaaatccgatgtgcaagtttctatacaaagccctgtacctgacagaatgcactgtaaaatctattctgttctcaattaccaattcgctagagttaaagtagtatatttattataaggcattatttgaaacatgttttattggatgtaaatttacaagtttgatggtgaatcaaatgttagagagttatgataaaatttttctctcaggtatagacttagtactttgattgtctgttcgtaattggtaattcagaaatatgtacagtttattggaatattgaatccactaatggttaatatagcagtcagatttcaaaactatataaatacatgaattttcattttgtaaatttcttaattatcgaatgtgaatgttatattttggcttataccttcgctagccttgtttgaatgtatggttaattatattttgtaattcttaggcaataaattgaattttaaaaaaaaaaaaa

SEQ ID NO: 538 - DNA, 974 bp, Leptinotarsa decemlineata
  Annotation=Ubiquitin-conjugating enzyme E2 C; Tribolium gene name from OrthoDB database=TC008974; Blast E-value Tribolium Gene vs. Leptinotarsa Unigene=1E-88
tttataatttttattgaactcgcaataagaaaaattacaaatacaagttgtcaataatacatatgaaatctgcctttgatattcaatttacgtttacctgcgtcacttcaaatccagaaacagaatcgatacaattttccataaaaatgtataaaagatagtaaattctgaggtagactaccataaaaataaaaataaacaacatttatatgaatgattatacaaccacataaaaaattgtatattgagttgtccatcgatcgtcgcagccctgaaatacttcaggttgaaagcatacgctcaaattcataacccgcagcttctatattgatcgccctaactaataatttacaattaatttaatattcaaaacgtcctcacgcctctctatgggtctgtaaaactaataacctgtattcttcgggaacctgccatttttcggcggcttgagcattcaaagggctatcgatattcggttcggacaggagagcttggatggaaagcaggatagtcctcacgtcatacagggctgaccatttatctttgaggatatcaaggcaaatgtttccagttatgtcgatgttggggtggaagcagggggtgacgaacttgactgtgggcgctgagtagggatacgagttgggaaactgcagactcaacttgaacttcagcgtctcgtaggcggtatctttgggccccataatggtgcccacccacttgaaaaggttctccccgtccgggaatgcagagatattctcgtcgtgagtcatcattagattcatcagttccctgtgaagtcttttggtcacggcgtgactgtctgtcacggatttcgcctggtcatcgctctgttttctcgaatcagcttgttgctcgacgatcgagttcatatttagggccattttgagctatttaaaaaatcaattgatttgctgttgacagtcaaaagttcgttaggaaatgtagaaaagaaa

SEQ ID NO: 539 - DNA, 1722 bp, Leptinotarsa decemlineata
  Annotation=Retinal dehydrogenase 1; Tribolium gene name from OrthoDB database=TC015614; Blast E-value Tribolium Gene vs. Leptinotarsa Unigene=2E-135
gtttaactttgaatatattttaatataagatcgggaacaatcataataattttgtatatacacccgtatatattcgaaataatttaccaatattaattctaaaatgaaattacaaaacccataataattccaggcagattttaaattgaatagtttataaattatgtccagagttcacatttttttcattttgaataccagtatttctttccatgtaatcaacatttcattggtaattttatcgaaatagtcttcgtctcaaggtagtcttgtatggattcttctcccaaatctcttccaatgcccgattgtttgtatccaccgaaaggagtttgaggggcagaaccaaaacagtttacccagacagaaccagcttcgactgactgagcaaaaactaaagctgtattaatatctttagttattatcccagctgcgagtccataataagtatcatttgctctttcaataacttcttctaaagtttcaaatttcagaattgattgcaccggcccaaatatctcttctcttgcaattgtcatatcatcagtcacactagagaatattgtaggttcaacgaaatatccctcattgccaattctgtttccgcctgtttccagtgtggctccttgtcttttaccctcctcaatcataaacatgattttttcaaatgagggtttgtcaatttgtggtccctgttctgtttcaggtttgaagggatcacccacttttttagccttcgccttttcaatggacttccttaggaattcttcatatataccagactgaacgaaggtcctggagcctgcacagcatgtttgtccatgatttacatatgccgcgatatgagccagttcaaccgcttcattaacatcggcatcattgaatataacaaatggacttttgccacctagttctagtgataccttcttcaaattagacttggcagcatactccataatgcggtgtccaacttttgttgatcctgtgaacgccactttcctaacatcgttatgtaaacaaagagcttctccagcaataggaccaaaccctggtatgacgtttataacacctgggggaaagcctgcctccttgactagagcggcaaccgccaaagctgtgaggggcgtttgttctgcgggcttcgttacgattgtacaaccagttgccagtgccggaccccatttccaaatcatcaaagtgataggaaaattccaaggtacgatttgacctaccactcctataggttctttacgagttagactgaaataatttccatctgcaggaatggtatttccatgaattttgtcacaatatccagcataatatcttaaaacgtttgaggctccatatatttcacgaacagcatttgaatatattttaccgcaattcaaactttccaaccctccaatttcctttgcattcctgtccataaggtcagctaacttattaatcagttttcctctctgcgaagcatccatggacctccattctgaacctcttaaaaaagcagctttagcggctgcaactgctttgtctacatctgccttgtcagcttcagcaatttcggcaatgattttttcagtggaaggattgattactttgaatgtcttgttactcacggcatcaacgaattcgttattgataaataacttgttgtatttcacttctatgattccagggtccatgttcaaagtcaaagttgatctccaaggaataggattc

SEQ ID NO: 540 - DNA, 660 bp, Leptinotarsa decemlineata
  Annotation=Circadian clock-controlled protein; Tribolium gene name from OrthoDB database=TC013560; Blast E-value Tribolium Gene vs. Leptinotarsa Unigene=3E-64
gtacataattgaataacttatcagcgaaatcccttatgagaatcagcagcttcttcttcacgtggggtttcatctctctcagaagctcttgactattggaattgatgaacaagttcaatgcagcttgtagaattgtgtttccgttatgaataccatcaactcccatctttatatttctaacactaaagtccattttgatttgctgtaccaccagatgagatcttccattcacataatggggcgccactctgaagtatattttgatttttgttccctcatattctccccagtaatttccaccaccggttgcttggattaaaatgagtactccactagattcatattttgctctaacgtttatttttggtatatacatggtcaactgatactggccagtctcgatatctgatctcacaccaacaacactgatattactgactccataggcttcgatattcctaaaagtggctcgatatccatctggacctgaacctaaagctagctgaatctcatctatgataatgggttctggatcatatatatctagctctggaatgccccttctgatgttagcaatgaggaagttcgtagattgcctaagacatgtgttaacagcttcatcgtctttgtagcatttcttgatgaagtaaggcctctgag

SEQ ID NO: 541 - DNA, 900 bp, Leptinotarsa decemlineata
  Annotation=Peroxiredoxins, prx-1, prx-2, prx-3; Tribolium gene name from OrthoDB database=TC012328; Blast E-value Tribolium Gene vs. Leptinotarsa Unigene=4E-132
gagtgacatgaccggtggcctgacctttcaaactgtttgaacttcagtaaagttaaaagtcattttttctgattttaaaatctttctgttcatttcggttattccccaatggctggattattcaataactttattcgtagggtgccacaattactgaagtctactgtaccgactgccaaacacataacccaaagaaacttgattttatcgtcttcacttttggcaccaaaggttcaacaaccagcacctgactttagtggaacagccgtaatcaatgatgattttaagaacatcaagttgagtgattacaaagggaaatatgtggtgctgttcttctatcctcttgacttcacatttgtttgtcctacggaactcatagcattagatgaaagaattgaagacttcaaagcattgaatgccgaagtgattgggtgctcaattgattcccatttctcgcatttaggatggatgaatactaaaagatcagaaggcggtctgggaaaactaagatttcctttactctcagatatcaacaaagacattgccaggacttacgatgttttgttagaatccgatggggttgctctccgggggatgtttatcattgatccaaatggtattctccgtcacatcactgtcaacgatctacctatcggacgatcagttgatgaaaccctcaggataattgaggctatacgatttgtggaagaacatggagaagtatgtcctgccaattggaagaagggtgggaaaactatcaaacctgatccgaagggatcccaagattacttcaaatcaactcattcctaaagaagatatgatcttgtggttattttaagattattttgcttgttgaaaaatttttgttatgtaatattaattaaatcaatgctttatttc

SEQ ID NO: 542 - DNA, 1183 bp, Leptinotarsa decemlineata
  Annotation=Putative uncharacterized protein GLEAN_07427; Tribolium gene name from OrthoDB database=TC007427; Blast E- value Tribolium Gene vs. Leptinotarsa Unigene=2E-125
tgtacagggcgagttgctgcagttgatcctgattgaatgcttggttggaaaagtcattcatcgatttgagtggggattgtgcctttttcgggcgaaggtggccttccattaacttcgacttttcgacgtcggataggtcaaagttggatccgatgttggcaaggtctaagtctgcggggagagataatttccgaagttggccgtcatcttgatcgttttggtctccgaattcaagttccaaatggagctctgaacctgcttcatcgagatgactgttgaattcattgagagttcgactggggttgaagtggtaggcttccatcggaggtaaggttttggtggcagttaccagccccgtcaccaaatatgtctgcaccaatgttgaactggttgtatcgttaccgtgtcgaacgacaggcagaatgtgcgtcttcaacatcgtctgcgtcgtgctgaatgtctccgtaagcgtctcgagaggcggcgtttccatgtccgaagctagatacagcggcggcagcgtcgcgacgctagaatccaagaagttgttgtccttcgcgtaattgctcgacgtcgccagatattttccgttaagggctccgctgccttagtcaaggtgggatccggggacgattccagacttttctcaaacgttgacgttaccgtcacgtaacgggtgttcctcacactgccaacctggaaagtgtagggcgacttgattgtggcaatctcataataaatgtcgccgaaatccggaggagtggaaatttctactttaatggtctcgactggaaaagcgggggcatcgagtttattttccttcgaactctcatcgtcgataattgaggcaattgattcagagccttctagactatcgccgtcgtcggatctagcttgcggcgtaacgacgtcattgattagaggctcctgcagagaagacgaagaagaggaagaagtagttccgagcgtttcgttgttgttcaatggctcgtcgatgttgttttgtttgcgaatagcaacgcgcggcttcgacgttgtcttgtactgccatcttccgggagatctgtttaacttgaacttgtacaaactggatgtcgttggagagaactgctctacattcgaaggctgcacctttggtttgtatcccctccggctaaatccgctgttagtactggtgtcagtg

SEQ ID NO: 543 - DNA, 738 bp, Leptinotarsa decemlineata
  Annotation=Neural cell adhesion molecule 2; Tribolium gene name from OrthoDB database=TC009766; Blast E-value Tribolium Gene vs. Leptinotarsa Unigene=1E-65
gacagacattgaatcgctagcctgctgggcgtccaacagcgtcggccgacaggcgagtccttgtttgttccacattgtgcctgcagaggctcccgaatccccgaaaagttgcacacttcgaaacgcgtcacatggagacggtctagaagtatcgtgtattgcaggaaaggacggaggtctgcatcaaagttttgttctggaagtttcagacacttccgctcctcacaatcctgcaggtataacaaccctcagcgatcaaggtgatcttccgcctccaaaataccgtgttctaggcgaacgccctgtatttcgactccacagtttggagccaggaaaagaataccaagtagctgtgtatgctgagaacgctaaaggaaaaagtactccccctgtagttttacctaatgttcgagttgaatcggatgtgacatttgaaatatctgaagacgaagacacaacccaactgaaaccagacccagaaagttccacttccggaaaaaacctaaccttgatcattgttggtttggcggtggccgcagtgctgctcattctgagtattattgcagttgctactattctggcctgtcggaggccgaaaactgttgtaaaaaggagaccaagaagaagcagtaagccaccagaggagttcgagttgtccgaagacggttttggggagggattccatagggagaagcgcgcaatatagggcaagcatgtacggagagtgtgaagatagaa

SEQ ID NO: 544 - DNA, 1037 bp, Leptinotarsa decemlineata
  Annotation=Putative uncharacterized protein GLEAN_15324; Tribolium gene name from OrthoDB database=TC015324; Blast E- value Tribolium Gene vs. Leptinotarsa Unigene=1E-129
ttcgtcctgtggaccgtgtcgtagtctcgaggtggaaggagaatgggtgagtttttcttaccgagtttttctcgaagttccgctgctacagagtcatagagcgttgtgacccgggtgttttcaacggtgaatctttcttcactactctcgctctccctagtcgacgttcctgtatcgctgcctatactactctcaacttttttcaactcctgcggcttcaaccgcccctctatctccgcgaatttcttctggttctccggcctctctatcagagtttgcaactgattcttcagaagtgtagcagtctctaaactatcgcacctataggcatggacgtgcaggggacatttcgtgacgggattgaataacagcaaaatgcaagctatgacgtcttcgtgttggtacacgcaggtgatggtattgtgagggatgaagtgttttatcgtttcatttttcggtttcgagtttttcgggttttgcgatacgatattttggatgatttttagacccttgtgtgaaacttggagggtaactttgaatggttccacgtctttttcgcgttcttctagatgtttgataacgggaagaatgtattctgtgcctcgcagtcctttcgattccttcgctcccaagaaccatacgtagtagcttgattttttaatatcttttcgtagttttagggccatttcatattatttttcattcattgttcaggtcactctagtcaacaagacttatggcactgtttttgtactatttttcagatctttcattaacttcgttatctacttctattgcttcactgaattctaccactcatttggagaagcctatcgttcctgtattaagttcctgcaaatatcctagaacgtcacagaaaggcaccgataagcacacacaaaacaccaaatttccggaataaaaattctcatatacgttgaatttccaacggatttcacaaaagttatccccaaatgtcaaaagtcctttacaaacaacccgaatcgcgattaattcaccatttgttattagtgctg

SEQ ID NO: 545 - DNA, 882 bp, Leptinotarsa decemlineata
  Annotation=Mediator of RNA polymerase II transcription subunit 7; Tribolium gene name from OrthoDB database=TC007575; Blast E- value Tribolium Gene vs. Leptinotarsa Unigene=1E-111
tttttttttttttttttaaaaagaaaatatatattacataaaaacttatattcaatcagataaagtaatgtcatggcatgttatcaataacactgcacatgatcctgtccaagatatagcacggatctgctttaccatcaccattatcatttttttcattgcctatcagcaaatcggtttctatcatgattttggaatccacctccatcggttctgggatgttttgtattgcttgctgaagaatatccagggctttgtctagatgtttctggaatctattagctgtttcaatcctttgcctcttctgtagctccatcataacccttagtgtctctctggcttgatgtggcctgaattcattcaacaagtgatggatatgaatgaacagcaggctaagatcttccaccttttctgctctacgtggggaatcagggcagttaacgagtagatccagcaagtcaagaaagttggctaaaagggactggtttaattttttcaactctcttcgcctatcgaaatgtaatgggtagagtctcttaataccctgactttccaggggccttataatactttcttcggtgttgaaagcgttgccaaacatatgataagtgtcttgaattggaggagggggtttgggggccctaccccgccggattagttcgtctgtgtattggttcacatactgcatagggggcagaggtaaagagctgacttggacagcatctgaattagccattttaggttatttgcagttaggcgatgtttataaaataattgtattgtattgaatgtacaagtcacggtaatgatattttacttatgttaaaacctgggaactatccgaaaactaaattaataacaataaacatcacttctactgtc

SEQ ID NO: 546 - DNA, 1678 bp, Leptinotarsa decemlineata
  Annotation=Cys-loop ligand-gated ion channel subunit-like protein; Tribolium gene name from OrthoDB database=TC009727; Blast E-value Tribolium Gene vs. Leptinotarsa Unigene=2E-122
acagatctgagcaaatgcaaaatccactattcacgatcaggaagcgtatacaaggatttctacaaaatatccgagtcttcgggagaaaatgacaccttgcggctcgattttcatttttctgtcttagctccaagtgatgcacatattcttctcgccccatcagagaaggtagagaaaggagatccagtctacgaaatagtaattggggcgggaggaaataccttctgtgacatccgcagaaagcagaagtccgatgtgagggcttcgatgagaataaaaggcttgctttctgctttggatccgcaatcgttttggctacatatcacaaaagatggagatattgctgtgggaaaagaaggagagcagttaccattcatctcttgggtagatccagatccccttccacttgaagttatcagtttcagtacttggtctggtattgaagcaaagtggtactttgattgcgagaggaacaatgaaacacaggaaattgagaaaccgctttccgctcacgcaaggctacgacgggatctactttaccactacaatccttatgtcagacccgtaatagatgtctctactactactaatgtcacgatgtctctccaaataagtcatattgatttgaatgaacaaagctgtcgtatggaagtcacaggtgtgacgaaactgatatggcatgacgaaaaacttaattgggatcctgatgattatgatggaattgaaacactccatatattcagaagggatatttggcaaccagacctagttttatataatggagttggtgatatacgaggaatattgggcgacagtgaaatgattgctgattacaagggaagggttgaatggaatccaccgatgaacctcaaagtatggtgcgatggcgccgatatgggaaaatggccgaaagagattcataaatgtggggtgatattaggatttatgcgggattcagcaagaactacattggaattcaacgttaacaagagttctctaattttccacagtttttcagaatggtcagtgatagaagctgacgtaatatctggaatttcattggagaatacattttcagaaccagcaattcttcaagtgactttcactctgaaaagaacctccaacattgtagaaattttgttattctctccattcgtagttatatctatttccctcttggcatcattctggatggatcctcttgggaaaacgaaaattacactaacttgcagccaactaattttaacaacgataatgcttcttgcattggcaaaaattgtaccaagtcattcccaaaatgtcccttttttggttacactctacagctttaccatgattgctttggtagtggctttggcaatcgctgtgattgtggtcaatttgtcaaggaataagaaaaacacatctgtgccactgatactgtcgaagatgttgacgaataaagtgatcagctgtacattatttttaccaaagataaatatgtctgaagagtatggaaagctgaacgaaacgggtccatcaaagtctcaagagaatagccagataacgtggattattctgtcacttgctatcgacagggtagctttcgtggtctatgtggcattgattgcttttgcaggatattcaaaatactgattcgattgttttgagtcctgtgtggatcaatataagaagaatt

SEQ ID NO: 547 - DNA, 1480 bp, Leptinotarsa decemlineata
  Annotation=Protein phosphatase PHLPP-like protein; Tribolium gene name from OrthoDB database=TC030752; Blast E-value Tribolium Gene vs. Leptinotarsa Unigene=0
cgatacaatagatttagattctctcgaggatatccaagttcccataatgaagcagaaagagaaaccgtgatcgaaccagataacaacacaaatcttcaatcagtgaaacatctgaacttaaacggtttatgcaatagaagacaagaaaccggtgtgtgttacaacgaagaaatcgttcttacaggggaatccatagagaccctcaatgagcttcaggtactcagtttacgctcaaatggtattcagaatttcccgtgcagcatccttcagcttgtaacgttggtaacattggatttatcggacaataatttgctgactttaccaccggagataaatcaactgagaaatctgcaagaactagtgttggatcagaatttgttgagtgtcttacccgcgactctatgggacctgaagtttttgaaaattctgaggctagcgaacaacagattggcagtaccgccggataaagtgttagatatgcggactcttgtgctcacggagccagatggaaaaactgaagactcgagaggtctaacaacattgaatttaagaggaaacaagttgaaaggacatatcatcttgggaaattatggctgcttggtccagttagatgtcagcgaaaataaaatagaaaatctggatttgagcgctgtggaacaacttcaaatactacaatgttctagaaattccttgacaaccctcacgttacatggaaaaaaattaacctcaatcattgcaggaaataatagattgaaaagtttgatactgtctcatccaccagtaggcctcagacacttggatatatcctataatgacctggaaagtcttcccgactggttgtcaagctgtaaagaactgggatccctcttcgccagcaacaactccctactatcattacctgatcatttattctgcaatgaaatgccattgctacacacccttcaattggcctacaatcagttacagtacctccccattctacagaggaagttacctgttcaagaattttttttacaaaataatagtttgtccagtatcccagaagactttttcaaatatgttccagatatcagagtactgaatctttcgaacaaccgactatgtgatctaccgaaaccgttcgaggtgctacagctggaaaaactttttctaacagccaactgcctgaatgataagtctatggagcgattggctccgtatctgaagagcctgagaattctacatgcagcatataataatttgaccactctaccggaaaactgtgctctcttctggtcggaattggaggaactggtagtttctggtaacaaactattgcgtcttcctgagaacatcgatcacatgaagcacctctcagtactgagagtccattccaacttactgcaatcgataccaaagttgtctacactcacatcgttgagggtgttagacttagctcacaaccagttagatcgcgtcgatcttaactctctcatacccc

SEQ ID NO: 548 - DNA, 1003 bp, Leptinotarsa decemlineata
  Annotation=Vitamin D[[3]] up-regulated protein 1, isoform A; Tribolium gene name from OrthoDB database=TC010863; Blast E- value Tribolium Gene vs. Leptinotarsa Unigene=1E-177
aggctgaaaataggtaaggttgatggataatgggttccagatttatatcctccttcgtcgtcttctgaacgtattggataggtggccatcattatgggtaactgaagcttaacttctttctgcagacttttttggttcaactatgaaatatacatcataattgattttgatgaggtggcaccctctaagattggtaggtggcaatgggggaatatatagttgttcattattccattcatctttttctccgggtttgattttacctctagacaatgaagccagttcccttttttccgattggactacctttcctcttgccatatatgttatgctttcggtcagagctgctctagtactctttattgtaactctacttctattgtaaatactagccgaaacacctatactttctcctggaacatatcctcctctatctaaggtaactttacaaactactgctccagaaccaacacaactaactccaaatttgtgctccacttcacatctaaatgtttcctgacccgaaatgtttcctaatatggctggctctaaatttaaatctataggattcatcacaatgaaaacctgttgatttttatgggtgagtccatttggttccctcaaagcagttttgcaaaaatattggacccatccatgtttacctaggaaggtggatggcaaacccagtggtaaaccaagcttgaatggaaaactgtgtatacctggagataaaaccgatggtccttgacctggttctcctagcagcctcatcctaaaatctatatagttttcacgatcatacaccctctcttggcgaggggtgcgaactctgactaccccttctccaacgacgtggaaatgtaggccaagtgcaggtgtatcatcctggagttcaataagaaccctgcccgacaaaaactgtcccgggaagtaaagtaacgatgtgttatcgaataagatgaggaatttcagtagttttctgggcattttgctcgtgtttacc

SEQ ID NO: 549 - DNA, 995 bp, Leptinotarsa decemlineata
  Annotation=Putative uncharacterized protein; Tribolium gene name from OrthoDB database=TC003154; Blast E-value Tribolium Gene vs. Leptinotarsa Unigene=7E-35
tttttatggttatgttttgataattaactaatgaaactgatattccctagtagagagttaagtaaaattgaactttatttttcattctctgactctcttataaaaatcggcacaattataaaattaggaacgtgcaataattattatggtgaattcaaaccttagtcaaaactatagctactacgaaactgaacagatatttgaatggtgccttgttaagctttttattaaaaagtggccaaaatggtgttctatctacattcacttcaagatgtaaaacagtattcttctctatcatacaatgaaaattattcaaattaacaatggtgcagccaaaatctttgggtaataaccaaaaatattccgaaaatcacgaatttgctttcgatagatcggtgaataaagaatccaatgtccaaatctctgtgcatggctgaacttccttctcaggatacaacttattcatcagaaaagacaaatcaatatcacccaaatttccaatgctaatttgttcactctgaaaattttcaaattggttgtccagttccttatatgttgatttgttcacggaaatgattggtttcacatctgacaaattcaaagaatcatcttggagatcatcgatatctggaattatcggaatatcatcatccaactcaactctgtcattctgaaatctttctagctctatcatattagatcctgcagcagatctagatgatttaggaggatcttcactccaaacacttgttttcttcaccttcacaggttcgaatgtgttttcatcaatactcctagtgagatcttcattttcttctaatcccatattttgatttgatcttctaccttgcttaggggcagacttttttcctgtcaataaatcgatatcttcatcccaattcatctcaaataatttttattgtggcaaatgattaactcaaatgttttcatttgtttatgtttatacttctcggtcgatttctaggttatcaacc

SEQ ID NO: 550 - DNA, 1142 bp, Leptinotarsa decemlineata
  Annotation=RWD domain-containing protein 2; Tribolium gene name from OrthoDB database=TC008349; Blast E-value Tribolium Gene vs. Leptinotarsa Unigene=7E-1; Blast E-value Tribolium Gene vs. Leptinotarsa Unigene=05
aatgcgaagtgtcaaatttgtttgttgtttttaaaaggacgttctgcagtttgatgcgtaagatctcatattattaacacaatattcagacatggacaagatatccacagaaaaactcaaggaaaatctacaaactcaactatcagaactagaaagtctacagtcagtattctgcaatccaggagaggtgaaagtggaggatatttgtaccctcgcagatataacagacttcgtagccgacaaatcaacatttctaccccaatacctggatctagtaatcaagctggtaatagatgatctcaaatttgaactctgcgtcactctgcctcacgaatatcctcacgctgaacctgaaattttcatccgcagcccagaactcaatcggtctacacacatccaactcaacaagaatatcaatgaattcatcaccagtcaagaaaaaggagaaccctgtatattttcggcaatatcctggctgcaggataacgctggaagctatgtgtcagttaaagaggaaacttctccgcagaaagatgccaaaaacgagaaattcgtgagatattggatttattcgcatcatatttacagcagaacaaagcgcaaggaaatagtggatttggcaaatcaattgagtataagcggtttctgtatgccaggtaaacctggcatcatttgtgtagaaggaagctcttccagttgtacggaatggtggcaatcaatcagatcgatgacgtggaaaaaaattttcctcaaagtcgaagaagaagacaaagaacagctaggtcaagacttcttgaaattcgacaaatttgaagaagttgtattccaaaatagtggcgtcaaattcaaccatatggatatgggagagttgcatagatatcttgagagtcgtggagttggatatattttcaaagatttgtttggagttgaagctaaatcaagttcccaataattgattttgtgataatctattagtgttgtttgaaaataacaaaggttttttatatgtcatatatctcgaaaggcaataattatatgtaactttatcaaaaatatcttcaagattattggatttgtcgctgaatggtgaaattttatagtttttctattgtttctttcaagattaaaccaaatagtttaca

SEQ ID NO: 551 - DNA, 1422 bp, Leptinotarsa decemlineata
  Annotation=Putative ribosome-binding factor A, mitochondrial; Tribolium gene name from OrthoDB database=TC009443; Blast E- value Tribolium Gene vs. Leptinotarsa Unigene=7E-83
gagtgtgctactagtgaatgacaagtttatttacgtctattgtaaaataaaaataatgaactatccacatttcgttggaatgtacttagacttggatatatgatatatataaataaactacaaccaaaagaaagataaaaataaatatactttactacaccttgaaggttatacataacctgcaaaattatctctcaaccgagtgtaacaaaatttgtatgtatcaataatttgatattgactggtccaataagtaaaatgtgccctttttgttcacgaacttggaagttttgccagaaaaccattcaaattcaccctttcaatagccagtcacaaatccatacaacagcaatcataaatggggcccgacaagctgcaaatgccatgaagaaaattctgggagttaataagaaaagaaaatttgttcactatgaaggggctcctgctttcacgccagagtcattcagtaagggttcttcagatggcaggccttcgatcaattctaggagagctgccgtgcttaataaactcttcatgaaacatgttacggatctcatggctactggagaatatgcttcagaaatactgggacatggaatagaaataaacagagtcaaaattgctccggattataagtgtctaaatatatactggatagcaagaggttcggaagatgaccaagcagtcgaccaaatactgcagaaaaatgctggatccctgcgacacgaactctctcagcttcgagtcatgggaaacgtaccgatgatacagtttgtcaaagataaacggtatgccagaatcatagcattggaaaagcgactagccatcgcagattacggtgaagattatgttccttctgatgaggcagtccaaatgaagtccgagttcgaactgtacgttccacttgaagacgaaactaagagacaagaagctgagttagatgaagagactccattggatgaaagtgaagagttgccttttccaccaatgcctcagaatgtcttgggtttggatcatgcagctatcttgactaggattagaaaacaagtgaagaaatcagaggcaccacatagacatgccaatcttacgatgaggctgatgagagctgggccacttttaaactgaaccaatcaattaataaagatcccgtatcactgggcagcagcaagactcagagagaagcctttcgggaatttttgcaccagcgacaaatactcaagatgaaagagaagcgaagacacaagaattatatgccagatgtagagtatgtaaaagaagaatttagaaatgcccagttttctaaacttgaaaaattcgatgataatttcgaccaggatgatgattttattgacgatgtagaggagaaagtttaaagagaaagtatcaactaataaaaagaacataatgtttactttgatttag

SEQ ID NO: 552 - DNA, 2159 bp, Leptinotarsa decemlineata
  Annotation=Patched domain-containing protein 3; Tribolium gene name from OrthoDB database=TC012361; Blast E-value Tribolium Gene vs. Leptinotarsa Unigene=0
gttccggatatattgaccgcctgaataaggaatcgcatggcaatgatattttcccctgtatcgtcaaacttcacgtctaaggagaacgaactgctcggcgctaaccaatactcttttagtgcatcggtgaatccttttttgttatctactgtgaggttcaggtaatcacgatttctctcagtatattcaataaaactgcgcaaccatgattcagtgtataatgtgtctgatatgtaagatgtattttcaaaagttctagtgagttcttcgacctgtcgctgaatatttggatctgaataatcgtactgaccagaaactatcacctgcactctgtagggaaactctctgtaataatcatcttctctgtcgaaaaactcgatggcataagaatcatttttggccacttttcttctctctaagccttcttctatttgagtaatgccatagcctgctccaagtaagtaaactgcgaagacaataatgacgatgaacttgacacaaccgttgttgagcacagctccgagatagtcccggaaaaataccatcattccgtgttctttattgtcttgcggattgtccatgtcggtgggatccactccaccgctacaaaaccagcgataaaggaagcatctgtcttttgatttagatacaggctggacttcgaagcaaaacactgagtgaagattcttctcttcgcagtagcctgatatggccacacaagcagcaaagaaagtcaaatgccatatgaagaggaggcaagttgcagctcctgaataaatgcaaaatattgtcaccgacgggaagggactgaagataccaatccagaaactgaagaaatcggttacagatgtaattgtgatagacacagccgcttctgataacatctgggccattctttcaggaacaggcgtttttattgaagtcctcctccaggctgctaacatcacgaaagtgtcatcgataccaattcctatcatcagaaaaggagcagctaaattcaaaccaatgaagtcaactccagcgtacatgcagaatccgaaaccacagagtgtagccatggcggcacttatgttacccagcagtcctaaccatggcttcgatcgtacccagtcgaacatcatacatgtaacaacagagaaaacggccattataatgaaagtagaagcaaagtatggtacaactgattgtgcatttttctccaattcatgtcccagtgtcccagatgtgaatctagctattcgtatatgttcaaacttgttttccttgtcttgaagttgttcgataagatctaagaatgcatcttcccacgctgcacccaacttgtccaattttttcgtgtcagagtttccaaaatacgccagttgcaatgatggcacactgatgatgaatccttcttcgctgacttcggtaccaccgaaaaatacaggaaaagcatgagcatcccatgtgactgggttgaacatgagaggaaaagtgaggttaatattcttgctttcgacatcgtccattatataatccaaattgagaatgtcgttggtgaaacaatccgtcatccattttgcgcacatgtctttataggaaaagtattcatcatcatagaacacagtcatattttggacgtattcatctagaagtctcaattctctccagacatcagctctcagcaaatttttgtcgccatcttttgaagtcacaattactcggccgaagcgaccagcccttgttattctagctacactaaatcggctgctgtagttgactttgaaaaaactttccactatcgctctttcgacctttccttcaccattgataggactgaaaaggtattcaggatctatgttgttctgtattcgttggaaaccagtcaatcctattatcgttacgagtataggaacggtcagaaaaatgacaggatgtttgcccaccagaagtcctaatttgtagaaagatttattcaaagtgtcatccactattcgtaggcccaccatcttgttgaaatgtttcagtgtaatccgaaaagctggagaacaactcggaatccaaaatcactggaaaaattattgtcaccgacacaaaaggttgaatacagaaactaacatagtcaaaattgtcaacgataataagcaaggaaccgaaaaaatcacctttttttaactagc

SEQ ID NO: 553 - DNA, 1872 bp, Leptinotarsa decemlineata
  Annotation=Succinyl-CoA:3-ketoacid-coenzyme A transferase 1,; Tribolium gene name from OrthoDB database=TC011712; Blast E- value Tribolium Gene vs. Leptinotarsa Unigene=0
attcataaattatatatacagtagagagaaagcaaacagataacctataggctaaaggtcatggttcacagaatttaaattaatatccacatccattattgaaaatatagagttatgagtttgtcccaacctagaattcattaataatttttgcttccaacacaccttttgtttaataattttcacaatgataaaaacggccgtgtgtacgaatacaaataagcttcttctcagtgccaaaataaattatttcccaaatatcagcaaggtttttactatacatttttccactaaaccaaaaagcaaagtgtataatgtgaaggaagctgttgcagacatcactagtggatcaaaaatattagttggaggatttgggttatgtggcataccagaaaacctcatagcagcgttactgaaacatgaagctaaagacctcacagtggtatctaacaacgcaggtgttgataaatttggattgggtttattattgaaacagaagaaaattaagcgaatgatagcctcatatgtaggagaaaacgctgaatttgaaaagcagtttttatctggtgaattggaagtagaacttacaccacaaggcactttagcggaacgaatacgcgctggaggtgctggcattcctgcattcttcactcctactgcttatgctacacttattcatgaaggaggttcacctataaagtatgataaaaatggaaaagttgaaatttctagtaaccaaagagaatcacagctctttaatggaaacccctacataatggaggaagctataacaggagattttgcactaataaaagcttggaaggctgatcccgtaggaaacttgattttcaggaaatcagcaaggaatttcaatccaactatggctaaggcggcaaagacaacaatcgtcgaggtagaagaaatagtgaaattgggagatatcgaaccagatgaggttcatgtgcctgggatttttgttgatagaattgtgaagggagaaaagtatgaaaagaggatagaaaaggtaactgttcaaaaattgtctgacagcaaagactccatggtcaagaaaaatccagcagctgaacgcagggaaagaataatcagaagggcagctctagaatttaaagacggaatgtatgctaatttgggaatcggaatgccaatgttggcatctaattatattccagaaaatatggaagttttcttgcagtcagaaaatggcatattgggtcttggtccgtttccacatcccaactgtgtagatcctgatttgatcaacgctggaaaagagacggtgacagttgtaccaggagcatctttcttcagcagtgatgatagttttgctatgataagggggggacatatcgacctaacaattctaggtgcaatggaagtatcccagtatggagatcttgccaactggatgatacctggaaaactcgtgaaaggtatgggaggagcaatggatctcgtagcagcaccgggaactaaagtagttgtttgcatggaacatactgcgaaagatggcagtcataaaattttagagagctgtggtctacctctaactggaaagcaatgcgtcaacatgatcatcacagagaaagctgtttttgatgttcatccagagaatgggctaactctgaccgaaattgcagaaggggtaggagtcgaggatattttggtatccactggatgcaacttccaagttgctgaagatctgaaagcaatgggtcaaattgaggttaattgattttttatgtgctaagactaactgatcatttttaattttttatcacttttattgtttcattgatattttttgagtaatatctactgatataataacatgtaaataatttgattatatct

SEQ ID NO: 554 - DNA, 1433 bp, Leptinotarsa decemlineata
  Annotation=Broad-Complex isoform Z1; Tribolium gene name from OrthoDB database=TC009535; Blast E-value Tribolium Gene vs. Leptinotarsa Unigene=9E-4; Blast E-value Tribolium Gene vs. Leptinotarsa Unigene=0
aaaaaccaatttattaaatagtatataacataaaaaaattaacaaaagataacaaaaataaactatatatctagttcctaataagatgcacctctgccatgtgcttcttatacccctcccggtaatcgaaagactctggacacaggtggcagcagtacatattggtcagatcggagtgcactagacgcacgtggtatttcagggcagactgattcgagtagactttcccgcagtggggacagttgccacactgcgaactgtggtggggctgcagatccgttagtctagccgctatgctcatttccttgaattcttcaggagtcatagcctcaaaattctcaggatgatcttcagtcttgatacgttgttgaaggaattcagaaggatattcaaaagtggacggactggatgactctgaagaggatttcgggactcttttgtcaaggtctacttctggtggcttacgaggaatgaagattgtttttgggaggtcttgaatgatgcagactttatcggattgataaggcactgatgatggagatcttcctgcttgtgaagtcaacgacctctctagaatactgctcggtttatcccttacttccaaagctgcctctagaattgaacctggggtatcagccttctctcctaccacaacttcgacattctcactcacatcatactcactgttagcacctagttcgtcctcagtcttaattttatcaacctcaactacctcgaactgtgcaggaatcgacctgtttgcctcgttgagcacttcttcagcatttccaggtggtgtaactgactttttcggtttgggactgagctttgctttcttttgtggagattcttgggattcgatgttggtttttggctttttctgaggaacgtatagtttcttttgtggtgcttcatcagagttcatcaaaccgagaacttgcagaattacagctgtgtggaggaaggaggatagttgttcttcagaaactgtgacctcgccatgatacatgaagtttattattgccatcagatccgcataagctacatcttttagtataacaatcggatgagggcatgggttttccttgaatattgttctgaaatagggactacaagcagaaagtataaatttgtgagctttgatattgattccatcgcaagtcagagtaacatctgcgagatcttcggtgctctgcaaactttcaaatgcactcaaaatgttggattgaaacctggtccatttcaagcaaaagtgtttggaagtcatggttgctttcggaggggattggcttccacattaaatacgaaattgtattgaactttgagttattaacaaaataaaatgtgcagaattaacaataacttaaaaataaccacgtattaaaataaaaaccaaaacatactgaacgaaattaaaacttcaaacgtcaatc

SEQ ID NO: 555 - DNA, 2668 bp, Leptinotarsa decemlineata
  Annotation=Shc transforming protein; Tribolium gene name from OrthoDB database=TC010804; Blast E-value Tribolium Gene vs. Leptinotarsa Unigene=1E-148
atgaacttattttattacgaggatcattataatgtaaataaatcacatatctcgtgacatcacactaacttttgataattcctattgtaagactttgtccaagacttccaatcagaatattgtaaatttttcaaatataacacttctttcttgtttttatattttctttgttatttagaagcactaagtgaatgataaaatgctgtcaaaggttatgtacgatggcagcaacactgaatccttctgaagtactttatttgaaaaaattctaagcagactataacgtctcaaataaattgattatgagaggtagcgagaaaaattttgagtgacttgtaacaggtgttattcatgactgaaatgctaatattaccataactcatgatcagaatagtacttatacaattatctttatatatatattcgattagttaataatatttggcttaatgattatgaacagcatatgccctgtgtgacaaaaaattacatacaaaattattattggcaaaaaaaagccccaaaaaatgattcaatacatattatctaaaattataaaaataatagttatcacattgtcttattcgaatttcgtatgacgaaaaaaattaaatatctcagaattaccgcaaatataatctagctagaaagaactatccagtaacatcggttcaaaattagcaagttcccgtaagtttttgtgtacgtgaattcagaaaaacctacaagaattatatcgatacattatttaaaaatttcataatattctgtatcaacccatgccatgaaataatctctaaataagcagatagaagggttacagatgtcttacaaaatgtatccatttaaatatttaggtacaaatgtataacttcatcaatttgtggtcattaaaagtaatcagtctgtgatccattatcagattgcactgacagtggttcgataggcccaaaacaaagcggtaatttgtagaactaagccgatgagatttctcaaagtccatcacagcaactcatttcaaaacgtctaactcatattatcacttgcattcttgcttttacatgcagttttcctaacaccatggcttgaaaattttataaaaatatccctgaaacgcttgggtgcaagcttgcgaatgtataagaaacaatttatgaagctcttggaattttatttctcaagaccagagcactctctgccgagactatgataggcaaagaattctcgtagtgaaactgaatcaaatggctcacactgttgaatgttctgttcttcgttctgaccactccttcaggatcaatcagtaataagtgctttttgttattgtcttgcattcctgaaagaacgaattgcctttccatagtgtttgtcgattctcgcacaagaaagtcgccatctttttgaagtaaactttcagcttcagcgcgactgatctgaccgtggaaccatacctcactttccagttgagctataggatcaccatcatttttgctgtacatcgcagtcgaatggtgggtgaaaggttgcatatcaaatacatccctttctctaggcatcactacactaccattgacatagtcgtggtggggtacatcatgaggcatgatgtcagtactgaggtctatcaaatttgaggtttgtactggtggcaaagtggtgaatggcggaaccagagatggcagaggtgggacaggtggaggttcacaaacatctggaggaaccttccctggcaggtcattgtaatagtctttatcagcatcaccaccttgcgaaaatgaggaatgacccaatgctgtccccagtgcaacaggtgatttactcgtgaattgctgaaatctcaattcaaatgcctggcctatcgttgatattacatctttggctagaccaccgatacattccaaaacataacaagctcggagttcgttgacatcttttgctatgtatcctacaaaatccattgtgtccgtatcgcctccagaagcaaaagatatattaggcatatcatgacttgcgattatatgatttgtatctagtgatatcagagacaaattgatactagacacattcaaatttgcgtgtgttcctgaaaatttcagatttggtatatctgctatggatttcagtacctttttgtcaacttttcgttttttatctaaattcctgaatcttgagtgttcacatactcggttgatgcactcttttgccacattagatctagttttgaagtctaatattttcattgaaactttaacttccaaacaaccaacatacctaacggcataagttgctccttgttttgccattaacttgtcggaatgaatccaaccattaattggtttcacattgaaggcagacattatatatgttcagaatcaggtcgataacaatattatttgggaacattaattttcctcctttctattctcaccagacccatccttcagtgtacaacggaaaaaacatttttgggaatgaaagttcaaaaaaaaagttcattttttaacgttcttaaaaccgaattcatcaatttcactatcatacaatacttttcccacaataccagtaaatataaacagaaattaatttataggatcaattgtactataactaatgaaagataaaggaatgttgttattaaagctagacataattagagcgtagtagtatt

SEQ ID NO: 556 - DNA, 2815 bp, Leptinotarsa decemlineata
  Annotation=3 UFM1-protein ligase 1 homolog; Tribolium gene name from OrthoDB database=TC000331; Blast E-value Tribolium Gene vs. Leptinotarsa Unigene=0
gaatgtagtccgcaagcaatcaagtagcaaagtgacgggacggttggtccaatagttataatatctatgtactttccatatgttttattttttaattattgatattcaagattgaggtattgaactgtgtgtataatttttcaatatatattcacaaaagtagttgattattttttgttcatccactgaaaatgacagactgggacgaggttaaaaggttggcagctgattttcaaaaagttcaactcagttccactactcaaaggttatctgaaaggaattgtattgaaatagtatcatggcttttggacagaaaaatgatcgaccttatttttacaagcgacggcaaggaataccttacaccttctcaactcgttagtgacatccgaggtgaactctatgataatggaggtcgaataaacttggttgatttagccaaaacgatcggagttgatttggcccacataaattctcacctgaatgatgttttaaaaggacacaaagatattcaagctgtattgggacaacttatagatatttcttatattacaagaattgctgcagagatcaatgagaagctgtctcaacaaggacagataaatgtcagtgatttaacaattctgtatgacttgcctgcagattttttgcaacaccaagttctcgaaaagaatttgggaaagctcatttttggaaaacaggataaaaatgatcctaaggaatttttcacagaatcatttattgcaagaagtaaagccaaaataaaaggtgctttgacaggattaacgaggcccacacctgtgtcagtgatagtgaatcatattggtttgagcgagaagatatttttcagtctctttgagcaatcagcaatgtacgggtctctaactggaaaactagccggagcacagtatattcccaatatttatgcaaagtctcagaacgaatgggtgaaccacttttacagacaaaatggctatattgaatttgatgctttaagtcgtataggcatatctgatcacaaaaactatttgaagaaacaactttccaatgaagattataaaacgttggactcttgtatagtgtctaagagtattttggaaagaattgaagcagatatcgatgaatgcattgccagcaagtcgttcattgacttgcaaaccaatttaccatcagttttcaatgaaaccgacgagcaaatggtgctggacacaattttgagcaatcagaaacgttctcaaacaattgccatcaacagttttgtgataagtaaggcatttgttgatggacttttgaaagagtgtgatgatttagtaaaagaaaaatctaaggaaacggtagaattaggaaagtatcagcagtatcagataagtttgcaagcagcatctataaaatttcaaaaatcagatgagatagtagaaaaagtggacaagagagaggaaaggagaaagaaagccgctggaggaaaaagtggtggaggaacacaagggcgagagaccaaaacaaagtctaccaagaaggcatctcgagcaggaaacagaaataattctgagagcgacagtgttgacttcgaggaaaaacgagctgccctggaagtagttagttttgacgacgtgaagggagtcatattaccaatcttagaaaacgaagctttagacgaagagataattgaactacttataagacatctgcttcccaaactgaatgaaaatggtcttgaattggctgccaacatttatgcgaccaccgtatcagatcgaacggctaacagaagacagacacacaatgaactgcaaaataaactcaacaccctggtgggagatgtgagactatatgaaaaaggattgaaactacttccccaagacttgcagggtcaactgtcgaagtatcttctcaaaactgtttgtacagatatcgtaaatgaaatattgaattatgtggcagcagaacagaattccaatgtagttaccaataacttcaacaatgatcagagattgaagtttgtcaatgagttggcgcctgaatatagaacttcacttcaaccgctggtcaaatctttgacaggacaaagcattgacgagtttatgatagcggtggaaagtggtttgacttcttgtagtatgatactaaaaaaaattgacaagaaaaaggatagaactgttgttctcaaccacaaatatcagcttttagaagagttgaataagtgtgaggatgtggccttggttctacatttggcgacaattgttatattcactactgctacccagtgcatgctccatttcagtggaaaacatttgatgggtgttctttcatttttgaagcaatatttgaatgaagaacaggcactggaaatgggtgcttatcatgattttgttactttgatgttgagtgggggttcagaatcagaaagtgctaaagagaaattgaaagagagaatgtccattataaaagcgattgcaaatgatttcaagaaacctggaagtgaaaagtcatgaatttaatttttttttgcatatgaaataatgtaaattgattgtaaattgaaggaaattcggtacatatgagtttcaatctgtttaaaaaatctgtttttccgttaaccagctgttgcacccctacgaacgataaccctcagaagtcgaaactcgtgcgagctgaggattaacgaggtcttaccttttaacgtgtgattcctaacacgggttggagcatagaaattgataatcgattgtttaaactgggggcttgaaccaccgaccaacacggtagtcaattcgagtgagtgaacaaggcatccacgtcgaaccgcctggttcgacgt

SEQ ID NO: 557 - DNA, 1039 bp, Leptinotarsa decemlineata
  Annotation=Transcription initiation factor TFIID subunit 5; Tribolium gene name from OrthoDB database=TC009210; Blast E- value Tribolium Gene vs. Leptinotarsa Unigene=3E-73
tttatatggatatattcagaggtgggcatgcagacagagctacggcattttacaagtgctatttagagtcggtagaaaataagtgtgatcctgtattcaaggagttgatacatcttatcgggagtgacaatgacttgaagaaatataaagaaaatggtaaattgaaagagaattttcgaaacaagaaaatcgttattaatataagcaaggagtcgttggcagggctgaaaaagtttgtattggaaaattgtcatgtaatttttttgcaagtcttacaaacctggtttgattttaatatcatctccgattatgtaaagagagataaggaagttgtgacagtgccttcaattgaatatcccaaagatgaaaaatttcagaaattactgggtgttattaatgaattgaaaaaggaatcaaccccaatatttaatataaaaatacatttcagtcaactggatatagcatgtggtttactaaagagacaatgtgagcttgtagcttttgctgaaaaaacaaagtgtatctaatgcctgttcatcccttgaactctttatttgacttggatgacaataaccgtcaagtagtattaaccaaccactcgggccagatttactgtatggacatgtcacccatgaacgatatgttggtctctgggagcggtgacggcacaatttgtatttatgatttagttaatatgacattagtgcggaaatgtgtgggacatttaggacctgtttactgtgttaaggtgagcggtaatggagagtttttagtttcgggttccatggacggaactgctagattgcggcagttaagaaacggaaatattttaaggatattttcgggacatactcaatctgtgacttgtgtagacttccatccaaattgtttgtatgtagctacaggttcaactgataaaaatgtcagattatggtgcattaataaatcttcgtctctgaggttgttgcacttctctaaggggactaattttttccctagcattcagtccttgtggcaaaaagctagcaagtgcatgcga

SEQ ID NO: 558 - DNA, 5325 bp, Leptinotarsa decemlineata
  Annotation=Ankyrin repeat and FYVE domain-containing protein; Tribolium gene name from OrthoDB database=TC030598; Blast E- value Tribolium Gene vs. Leptinotarsa Unigene=0
tcaaatattttatcggttcaatcctctgatataagctttaacatctatttggaattattttgaactactgtggctaaaatggctcagtcttctgaggtcacaaagcttcaacagcatttgtcacttctgaaacaggaatattcaaaacttcaaaccaaatacagagagattgaatcaaaatataatacaatagcggcaaccaataatgaaaacacagaagatacatttgcatcccgcctcttgaaaaccataagcaatctttatgactcggaaatatatagtgatataaaaattaagcttgctgatagagaagtttctgcccataagctagttctccatgcccgcagtaatatttggaatgatgccctactaaagaacaaaaatgaacttgactggactgaaatggattcagatgtgggaaatgccatgatactctggttatacaccagtaatttgagcttatcctcctctgttcttgcattaaagctcataagaaaagcatatgagttcaaacttgtcagcttggtggaattgtgcgaacagtttttaatatcggtagtgaacattagatcctgcgtaaaattttattcggttgccgaagaaatagaggccattaatttacgagaatattgttcaggacttatatcaacccattgggatgatctgaatacatctgactttgaacatatgtcggggcccctgctttacaagatgctcaagagtaaaacacagttgcctttacattcagcagtgaggctgcagagagaagacgtggtgtttctttgcttggtggaaaattcttcaaggctgtcagacatcgttaatctctggagtccaaatggtgaattgcctctggatttggccctccgttgtcgcaacgaaagtatcggtgccactttggttcagcacaacgcagacctcaatatccgcgatagcaagggagacactttgttacatagagcaatcaaacacgaagactcgttttctgccttgtttttgttagagcaaaattgtgatgcaacattgtctactagaaatgaaaatgattctgcattgcacctgatcgccggtgctaataacattgaagattgtgagaaaattgcagagaaactcataaacaaaaacgtcaatgtcaacgctcaaaatcgacagggattcacacctctccacatttcgatccaagccgacaacaagccgatattcaatctgctcttgaagcaggactatctaaacgttaacctgaagacgaacgaagaacatactccgctttatttctctttgctcaaatatgaatcgggtgatgacgccgaagactcttacgccgcagctcttctccaacgtgacattcagactagccctgtgtattctgagacttgtaacagtctattacaggttctgattttgaacggtgcagagaatgccgcaatttttttgagtggaaaggtggggaatttagaccatgttaacagcgaaggggaaacggcattgcacttggcatgttccaaaaattgccgacaattagtacgttctctagttgaacttggggccaatgctaatcttctcacaaacgagctgagacagtcggctttacattatgccatcaaaagtaattcggaagaatgcatcagggctttgatagacttcaacactgagctggaaaagaccgagaatacagcagaatccagggtcccttgcaacttcaacttggcggacatgaacggagatacaccgataagtttggctttgaatgagggctacaatcacttagttccagttttgattgagggaaaagcggatgtcaatattagaaacggaaaagactttactttgttgcatctagcaattttaaaggaagactcaagcactgcaattttcttattgaaccatggtgtagatataaatgcaaaaactagtgattatgaaacgccactccagcttgccatccactgtcgcttggctgacgtagtggatgcactatgtaccagaggggttgatatgtcggctacggacaaacacgagaactgtgccttgtgggccgccttagaccatgggcaagaagacattgctagcatactggtccgccatggagcagatactgattgttggggtcctggcccggagggatgtcgacagactttattacacagggctatcgatgaaaacaaggaagcggcagcgatatttctcatccaagcagggtgtgatttgaactctccgaggatgcctggtccgaacggagcaggtggggatgaggccaaagataaacgatcgcctctgcatctgtgttgtcagtggggattggaaccagttgttaggactttggtagaacacagagctaacgtgaacattagagatgccgaaaataaaacgccgcttcatatcgccatagaaagtcaacaagatgagataatatcgttgctgttgagcgttccagaaattgatctgagcataagagataaagcgggtttgagcccgtttgcaactgcattaacttttagaaacaataaagcagctcaagcaattctggacaaattgccaagtgcagcggaacagttcgatgcaaaaggtcagaactttcttcatatcgctatcaagaaaggagacattgagagtgctttgtttcttctcacagtgcaagtggatgtcaactctagagttcaagatccgatgctaactccgcccattcatttggctgctcgatatgggaacgaaacattagtgagaagtctaatattagcaggtgccagagtggatgacagagatgctcagaaacgtactgctcttcacgtagcttccgaagctggtaacggaccagcagtatctgccttactccaaaataatgcagattgtgatgcagtcgatgttgaaaatgacaatgccctacatattgctgtcagagaaggacacctgaatgtcgttagggtattactgactgaatctacaatagacgcggaggcgaataatttaaagggtcgaaatcctcttcatgaactctgtaaattaggaaaagaaaatgctgcagctatttgcgaactatttttagagtgtatgccgaattatcctataaataatcctgacattatgggcaattcacctctacttctagcctacatgaaaggtcacgcaaatctctgccgtgttttggtcaaggcaaacgcttgcctttctaccgaaaactgcgaaagaataacgattttcaattatcaggtacccagcaagcaacttctcaatcgccttctggatcaactatcccaacccgcaacttggacaagcaccgactcgtgtcaagagtgtggcaaaaatttctcaatcacagtcagaacacatcactgcaggcactgcggtagggcactttgcagcaaatgctctgatcaagaagtgccaatcattaaatttggagaaaacaaaccggtcagggtatgcaaagtgtgttttgatgttttgaaaaccggtgcaagctagagtggatctgttcttgctggataagaaccgagtttggatgttgtcgattgaagtgagcgaatagtatgattgcggcaacaaatcaataaccgaggatgataatcgtatctactagataaattcaacatcgcctcaaaaatagtgtatttatccaagtttaatgttttatatatctgtataaataatgttttacgattttattaggatcaagccatgactgaatgtgatgagaagtttatatcaataacaactttgactgaaaacatttcagagttcttgactcattatttagcatgcatcaggtatgttttcgattgttaaatatgtattgcacatgatttttctcttcactaattttactaccaaagaaatactaacgtgaggaattactgtcaaattatatttactaatacattccgttatctgcgatattcaccaagtgaacacatctttcagaaccagaagtttcacattttctatgagctcttatacttgaagttatttttacgtttgagttgaagattgtagaacaatctttatcacacttcactgtcaaatgttccataaaattgctttatattagattatatattttttgcagtttgtttttttgttatcaattttttattcgagaaacacttcattgtgaaattttcatttaacagtttacaaaaccgcaacatgtgtttcactatacaatggtttcctcaggcatgtaaattgagatttatgctttttacacctcatcagtccaaatttgaaatgaattcaaagccttattccttcttttgaatggtaaatcagagcaaagttcttagttcaaagttccaatatttgtatcactactttttcctcaagtgtagatgttcgcacaaaacaaactcaaatttttatgtttttatcaacaacccaaattcgttagtttccatatcaatattcatcacattggaagacttttgtgaatgaaagtcagatccaaggatggtaatgatttttttggatttaatgactgataatttgtttttttctgtatgttcaagaaaattctcagccacatgccaattctaccaaggaaagagttgaagatttgaaagtaacaatagagtgaattggaattatagaattcccttgaagatttttcaatgatttctttctgcgatctactccatagctttatcagtatatttgccgttcttagacttttgaattttggaatatttaatgcaaaatctagtttatatgaaatgatataaaaatagatttttatcaaagggtatttcgtaatgttacagccataataaacttagtttcctatgaactgattacttaatcatagcaaggtttgattacataataggagtatttttgatgacgaagaatgtatgtataatgatgaataaaaagacttcagaaaagagtgtgtaggttctattaatgattgcctggttgtcattcaatctatagtaagtttcacgatagtttagcttcaaatttgtttaatatcctcctacatcattgcaatctgtaaagaactgatgtcaaatgaataccaagatacaagatatatttttctatacctgattcgttattaattgaaattcagtgtgagtatcagttggtgtggaaataatttttttttgcagtttttggtacaacatatatacataacaatctttttttattatcataccatcttgaattgaatgaaaaaatagtaaccgcagaaatcggtcaatacctttgaactttcaatcaagaaccgctctggtttcattaattgtgtttattatcctatgttccattaaacactctatattgtgtaatgttacttcaatatatattttaatgttgttaacaagttct

SEQ ID NO: 559 - DNA, 663 bp, Leptinotarsa decemlineata
  Annotation=Hyaluronan mediated motility receptor, putative; Tribolium gene name from OrthoDB database=TC012383; Blast E- value Tribolium Gene vs. Leptinotarsa Unigene=4E-81
tggtcaaaaattcctgagtcaattccttaagatgtttctccttttcagataacttctcttttagaattggtatctcattattggctgatacaagtctacccaaaatatcgggcgacggaagttctccagttttttcccactttttcatttcttccgcaacagattcctctttcattttattatctaactctgctttggacaatgcagtggacagttcgcaaacgtcctgattcaatttctcgacctcctccctctgcttgttcaactcagttttgagactgtccatttcggcatttttcttgctcacttgagccaaaagatcctttacttctgttttcagtcttgccccgagtatttcccaatctttcaactgtttaaccacaaccttgttggtttccttttgcttatcgacttgttcggataaggtgtccttgtgttcctgtaactcattcatgcagtcttcgttctcgagttgaattattctaataactttcaatagtcttgttatcaggttatcgacgtcgatgacttgatccacgagagagacagatggaaacatttcacttaacgacgccaaatcacatgtaaaggaagtagtcatactgccatataaactcacgactagtgggttctgacatttgtctattgtaaatagcattggat

SEQ ID NO: 560 - DNA, 2468 bp, Leptinotarsa decemlineata
  Annotation=Probable ubiquitin carboxyl-terminal hydrolase FAF- X; Tribolium gene name from OrthoDB database=TC010455; Blast E- value Tribolium Gene vs. Leptinotarsa Unigene=0
gaagattggcagcgctatttgcaaaatcacgacgtgcctgcaaaagtatttctgtacgtcaacaataaaagaatttgttcatattcaggttgaactcattgtagtggataaaaaatatttgtgtgaattattatccattttcagtttgttatttctagtgagagatatttttagaatatttttaatcgttgattttggggcgccattttgtatatgccggtggatttttcatagacttgtcaaaaaagtgttctcttcgaaaacaattgtatggactcctgaagcactggtgaaattaaaatcatcggaagtcctcaggaccacgtaattacaaacagtggtctagtctaaaatggtaatttgaaaatagaaaatacactgaaatatgactattgcaaccagaggacaaggaatcacaggagatactattgaaacacaaggatccactcccggcccgtctgaaaataatgccgaggaattacaagatgaaaatttcgaacccgattttcccaaagataaattagcctccttagatgaaaagatatcaaacttacgatgggtcgtaccggtactagccgatcaagaactcgaatgcctcctgaaagcatccatagacttggcaagaaaaaatctcgatacaaggtcggaggcttgccaaagatttttccgtgaaggattgacggtgtctttcacgaagatattaacagatgatgccgtatcgagttggaaacctaatattcacgcctgcatcaatcagaattgtttgaaactcatcgaattatgcgtcgtgaagctgccgcacgactggttccctcttctagatctcctagcaatggtcctcaatcccaacaataagttccatagtttcaattcatcccggccaagcgagacggcaggtcctaactcaaacttgtcggaagaggagctttttgcccggccttctagcgaccttcgaaaccccagaggctggctcgttgacttgatcaacagattcggggaattgggaggttttcaggcacttctagatagatttcagtcaggaaagaatctaagcgtctcggtggtttttgcgttggctagaccttttggcttgtgttacgaattcctaactacacatacaatcaacaaatatattctacctattctggaaatgattcccggtatacttggcaaattgactgatgatgagctgaagagggaagcaaaaaatgagcaaaaaagcgatatagtctcagctattataaaagcgtcaaaaaatttggcgtcaagagtaccgaatcaggaagaactaataagagacagtttggagggatttagactgaccatgattctacggcagttgcagatatcaagtttcaatggaaaaatgaatgcccttaatgaaatcaataaggtaatatcgagtgttacgtattatcccaacagacaccatggtatggatgaagaagaatatttaactccggaaaggatggcgaaatggataaatgaaaataaagttctagaaatagttctaagagattctctacaccagcctcagtatgtggagaagttagaaaaaattctacgttttgtgataaaagagaaagcgctgagcctcaacgacttggacgcagtatgggcagctcaagttggtaaacatgaagctattgttaagaacgttcatgatttattagccaagctagcgtgggacttcagcgccgaacagttggatcacctgttcgagtgtttccagaacagttggacctctgcatcgaaaaaacaaagagaaaggctgctagaactgatacgtcgcttagcagaggacgacaaagatggtgtgatggcacacaaggtgctaacattattctggaatctcgcccattcagaagaagtacctacagaaataatggatcaggctctcacagctcacgttaaaatattagattatagctgttctcaagaacgggatgctcaaaaaacggtgtggttagacaagtgtgtcgaagaactgaagaacggcgagagatgggtgttgcctgctctgaaacagatccgtgaaatatgcacactttatgaacaaaatacgaacggtggtcatactcaacgtactcatcatatttattatagacaagaagtgatagaaagattgcaaaaccagcattctttagttatattagttacgaatagccttacttgttacatggatcgattacgtgtattgtacaaagaaaatcctgaattgacatgcgaaacttacatccctgatggaagatactgccatgcgttacaagttcaagaaagactgaatttcctcagatttcttctgaaagatggacaactatggctgtgcgctgaacaagctaaacaaatttggcaatgcctagccgaaaatgcagtattcctgtcggacagagaggcctgtttcaagtggttttccaaattgatgggggaggaaccagatcttgaccccggtataaatagagactttt

SEQ ID NO: 561 - DNA, 2389 bp, Leptinotarsa decemlineata
  Annotation=CG9413, isoform B; Tribolium gene name from OrthoDB database=TC000583; Blast E-value Tribolium Gene vs. Leptinotarsa Unigene=0
ccggcgacagcgaaggcggcgggccggcggcggggtctgaaggctcagccgcagcagggcaggacaagctggagaggccgagctcaactgagaatgacactattcacctccagagacgggtgggactcttcagtggggtggctttaattgtcggaaccatgattggatccggaattttcgtttccccgtctggacttctagaaagaacaggatcaatcgggatgagttttgtgatatggatggcatgtggattgctttccttattgggtgccctagcctatgcagaactaggtacgatgaacacctcttcaggagcggaatacgcttacttcatggacgcttttggagctccaccggcatttttgttttcctgggctagtactctggtgctgaaaccatcacagatggctatcatctgcctaagtttcgggaaatatgccgtcgaagcgtttgttacagaatgtgaacctccggaaattgttgtcaaaatggtggccctactagcaatagtcgtgattctatatatcaactgctacagcgtcagccttgcaaccagcgtacagaatgtctttacagctgccaaacttgtagcagtactcatcgtggtactcggaggtgcctataagatgtttgaaggaaatacccaacatttgatggaaccattcaagaatacgcagtattctctggggaatatagcaacagcattctatactggactatgggcttacgacggctggaacaacttaaattacgttacagaagaaataaaaaacccatcaagaaacctgccacgtagcataataataggaattcctcttgtgaccgtttgctatgctctcataaacgtgtcctatctaactgtgatgtcacccatggaaatgatgaccagcgaagcggtggcagttactttcggaaatcgagtgttgggagtcatggcctggttgatgccgctttcagtcaccatttcaactttcggctcagccaatggaacgttgtttgccgctggacgactctgcttcgcagccagtcgggagggacatcttttggacatcttgtcgtacgtgcatatcaggagatacacgccgtcgcctggtttaatattccattcactaattgctggtgccatggttctctatggtaccatagattcgctgatagacttcttcagtttcactgcttggattttctatggtggagctatggtagccctcatagtgatgcgtcacaccaagcccaactaccccaggccctacaaggtgccaattatcattccgtatttggtattagtgatttctctgtacctggtgataggccctatagtagataaaccaacaatcgagtacctgtatgcatccttgttcatacttggtgggatggtattttactttcccttcgtccactacaagctgcgaataccattcatggagggcgtaacagtatttctgcagatgttgcttgaggtagctcctacatcaacgatgcttgaatgaagatactaaggaagaacatattcagctggaatgctcaattgattagtattagtatccgttgtatcatggttacagattttatatctcgataaaaaagttagatatacttgaagccatcattgacagtttgcagaaaatatgtttattattgaattcaataaattgtgaatgatggcctgaaccattccaaattatatttattatataacgacaataaaatctaaaaaggttcaactctctatgtggtcgacgtctctctgttataatagtaaccatgatatataatttattagaaaaacttttgaaatgtttgtggtaaatatgatgctgttgccattcctcacccagatcattgtaaattttgattatcattttcaaatcacgtttatatttttttattatgtagactgaatgtgacttttgaaatataaacctacccaggcagacgcttctggatctcatcgaattaaaataatttttatcggtataagattttgaatttgaatttattcatcatactatgtcaaaagcatgcatttattcaaaaattctgaaactatggatctataaagttttagatttcgctaatgtgactctcaggaaaggcaggggtagccagaaatatactggatcaaatattgttgaagtgtttaaggtgcttcatcaggttcattttgaataactgttgaacattgaaattgttttgaaacatgattcattgacactctgtctgcattttgaacaaacatatcagattttttgtggttttcaatgctctgtgtagcttatgttttttcaaagatttcgatttttgttagattttttcgacatgaatttaattgttatcaaaccaaatgttccatctatacctcagattaattgaaataaaaatttgaagc

SEQ ID NO: 562 - DNA, 1543 bp, Leptinotarsa decemlineata
  Annotation=26S proteasome non-ATPase regulatory subunit, putative; Tribolium gene name from OrthoDB database=TC006260; Blast E-value Tribolium Gene vs. Leptinotarsa Unigene=0
ctaaactaggttttattgttaaatccagcgttacaaactcaaaaagaactgttatgccacagcctgaaggttcttataatacactcctccttattgataagatgtgtgattttgttaactctctgcatgacctgagtgagatcgtgggcccagtcatttagaacatcgctaggatctttggtttgttgaaagtgcaccactccagcaggccgatccgttttggcttggatggatttgctgacgaccatctgggaaaggaaatcctcagtctcggcaggagagagatcaagaagttcggcgattcgcgttattctgattctggtgtaatactttgccatgactcggatgttgtgttccacgactcttgattttaaatctgcccatctttttgttgcagcctcatcttcagaaaaaacaggtgtggatttcagctgtttttcgtacacctcacataaaccagaccattttatcagttccggagtagtgaacaatttcaaaagtagcttgtataatggaatctcttccaaaattttatctgccaacaccctatgagtcaagtcaacttgttcactgtcgtgagtagcaaggatgaggtataaaacaactgcttgcgcagcactttgtctttcttccggaacagccatgatgctgggggtgttcaaaacagccctgtaatgtttgcaggtagccaaataagatccttcgtgttgatcaactgccatcatcaggcgataatatttaagcttcagatcggaggcagcttcatcttcaaagaacttagtattgatctttttcgatatgatttgtgtacgaatatagtcctgcttggcaagacatagtctcatttgttctagaatcagctctactttttcacgtttttccatagagccataagtttcaacttgtagttcctgtataatattcgcagcctcttcaatattaccctcttcttcgcgaattttagctaacttatgagttaggcgagcccgctcaacttcaacgtatatctttccttctgtaacttgccttaacgtatcaatgagtttgaccttagtttctttgtcaggtgtctcatcaacataagtgcagcattcctggaccatttttgctaccgcctgtttcaactgcgaccttctttttgtcaaaagcactatgtgttcattaagagcagcccagttttttgcttctttacaaatttgacacactgcaactagtactctgcctgtagaaatcatgtccgctccagttctggtttgcttttctaaagccaataactggtcgagggcatcatgtagtttgccagatttggccaatttttgacattcgggaattttttcgtcgcaagtagcactataatccacttccattttgacgattttaccagaatcagtggctattgactccatgttggttattttatattgttagttgaactaggaaatattccaagttttcaaatttgaaaaactgaattgaattataaaccacaagtcatgtacatttacaccaaaacaactaatttgttcctcttcgtttttgttcc

SEQ ID NO: 563 - DNA, 3220 bp, Leptinotarsa decemlineata
  Annotation=Phd finger protein; Tribolium gene name from OrthoDB database=TC006094; Blast E-value Tribolium Gene vs. Leptinotarsa Unigene=0
agtcatgtctccatttatctgagattgataatttagtgcattttcatatgctttctttactgcttttctatctgtaggcttccttggttcgtttacctttgattcatccttttctgcatccaatccaagtaattccaatttttcagcgggtagccactgccaagtcctttttggcatcaaaaaacaataccaaaaatacttgctcagtataattttttttgacaaatcaagtacttcctggggaggagatggaattggcacatttttgtaaacatatcctttagaaatttgaggatcaataattaatgcagggtaccaagggtagcctctacacttagcccaaaccaactgtaaaggcttcaactccttttctgcaatcaagccctcgttggcagattgagtggtgctgtcagagtagtcactgtcatcatcggaggcaatttcagacagtgaatgagagtagcaggttgacaagctgttgtcactgtcgctgttttcttcatctgtagtttgaacaccagcccgatacactttgaaactatctggaacagcatttgcatcttttttttcgagttttggagtagactcggcagaactgcgagattttcctcttttttttaattttgcagtaggtgaagccaaaccatctttttcttctttatctttgtcttctcttttcaatgctgcttgtgccttcttggtgaagagaactgctgttcgtctattgacacctgaggacgaaacaaaagttgcagaactgtttcttatgtcagcattttcattttctatgtgcacatctacatcagactgtgatgtaagatcagtatctgtctgagctgctaatttttttttcaccctattgatttcacttcgcactattttcacccttttacctcttgccaacccatgctttaacgtttgacttttaactaataagtcttcaagcttcgccaaaacttcagaccctgatttaccctgtagattttccaattctttgtcaatttcagatgccatagattcttcgacatgtccagatccagaattcatcttgagacagtccttattattgtttaacaatcctgcagcttccagttccttcttagcctgtctgaagatgacaccacattgatctcgcattttaatagcagctctgtaaaatactgtatctctattgttataggctagacaattcgctatcataaggtcaaaatctttttctaatgttatcaaatctggatatttcccttcatccagtttctttttcattgtactgaggtccatcgggtccgtaactacagtggtgtagtctggtacctcttcaaggtctactggttcagtgaatatttcattggtgtctttagcctgtattaaatccaaaacatttctcaaactagcttctagtggtttcagttttatcctaagacacttctctgaaactctagtatattctaatttaattttctccctttttctcaccaactcacaaagcagtctggccctttccaaatcctgtctcagacactgccagtatttgagctggcgacaaagttctatggtatctacgttactggtatttgaatccttaagacccccttgtgcactctgtagtcttcgaagcagcggaactccattccggaattgcctctttaatgtccaataagctataagccgttggatgaattgagatttttttgtaatggttactaatgaaccaatttcctgaatacgttcaggaggaatggtaggaatgaggataataggggccgaagttcgtttttttgctagcatcttacgagcctgaatcattttttttctagaatcatctttctttgaatccccattatctgcaggagcgtgggtatcgcagtaggcaattttttggactaaaacaggctgagaatctcctcctcctttaactgtatccatgttcatgtataatccagcttgttgagcacaagtaacatggaaagcagaataacaactgcttttgtggcattgaatgcaggcccctacacccttttgtttacaaacatagcatgttagtttccaacgggctgctgggatcgtctcaatggaatcaattggttctaaaaagacagtattagcaaatcgaacttcaggaatccacagagcacatacaacatgcgcccatgtacttcggtctgtttgtttgaaggctccacctttattgggacataacacacaatccacagctctgctgggagattgtaaacaacgcctacacaaccattgtccctctggtatgtacggtacaccataacaatcctgatgaacagccaagttacacatatcacaaaaaagaataacattggtattttggcattccccatccatgcaaatgcagcaaacagcatcgtcatcaaccactgatccagaatgtccattgaccgatgcctgaaaatatgactctttttctaaacggtccataagcaactctagagaatctactgaaacaggtgctaatcctgcagtttctcttctttcattcataatagacagccacgcagtatcttcttcatctacatcatactcaacttctccatctaattcttctgtacttttttcgataaatcgaatgtatgcgttgggtcttgaaggtgcatcgcatatgttataatcttccaattctctgtaactagcttctggaagttgagtaacaggttgcgagacttgatcttcaagcttcatttcagtgacttcatcatcagaaaaatcatcttttgagatcacatctatgggttcattgatattccacctgcaacctactccattgacttcaaactgtaccattttttgggcttcttcaaaagttaaaggttctggagcatgttgtgttgggggtaccttaactttcgttaatctatttcttccttttttgttccttggagaatttgtagtcactggtggtaatggtgttggattatcatgatcaaaacttttcaagtgatattgtaatccacaaactgatttatatgatcttgcacacttctgaataggacatgtataaggaggtccatgatcagcccttacttttctgcagtgttcaagaatatcgaaatctattcccatattatttgggtatagttctgcttttctaactgcgattaatcttgatacttgagtatttataaaataaaatttctaatattgtttacattcgaattatgcatcatatcatgattttctactattgtcagtc

SEQ ID NO: 564 - DNA, 2343 bp, Leptinotarsa decemlineata
  Annotation=ATP-dependent RNA helicase SUV3, mitochondrial; Tribolium gene name from OrthoDB database=TC012348; Blast E- value Tribolium Gene vs. Leptinotarsa Unigene=0
ggtcattgtcaatatgttaacctataagtttatgagctaatttttgttattcgaattctacagtcaaaaaaatgctgcaaactggccgcaaaataaaaaacctttgtgctacagctcaaggcttatatttgaaccattcaaaattgataagtgaaactggtgtgaagtgttcagtggcttactttcaaactagaaacaagaaaactgattctacctctatatcttctttattcgtccctgttcagataaaacccaatccggatgacataaatgttggagctgagctaacaggttctctgaataaagcggatctattgaaggttttgaataaattttaccaaaaaaaggaaataaagcaattgctaactgataatggcttagacagttatcttcaacatcaagcatacgtgagctttcgacgatactgtttggaagctcagaccttaccagtagacgttcatgtagttttcagtgatatcttgcaaggatctggaaacgtaactgatattttcccttatttcctgcgacatgccaagttgatgtttccccacttggactgcatggaagatttgaggaaaatttcagatttgcggacaccagccaattggtacccacaagctagagcagtaaatagaaaaataatatttcatgctggtcctaccaattcaggtaaaacctaccatgccttagaacgtttcataactgctaagtcaggagtatattgtgggccgcttaaacttttggctagtgaggtattcaataaaacgaacaacagaggtacgccttgcgatttggtgacaggggaagaacgaaattatgctgacccatcaggaaatccttctgggcacgtttcttgtacagttgaaatgacatctgttactagtcaatatgaggtggcagtcattgatgaaatacaaatggttaaagatccccaaagaggatgggcatggaccagggctttcctagggctcattgccgaagagattcacctgtgcggtgaagcaggcgctgttgatttgatcagacagatttgcctgaccactggtgaagatttagaggttcgtaactataaaagactgacttcgttaaaagttgaagattctgctgtagggtccctcaataatgttcttccaggagattgtgtggtctgctttagcaaaaatgatatttattccgtgtcgaggggcatagaggctactggtaaggaagtggctgtgatatacgggggtctcccaccaggaacgaaattagcgcaagctgcaaaattcaacgaccccgacaatagctgtaagatattagtagcgactgatgccattggaatgggtcttaatttgagtatacgtaggataattttttattcccttataaaaccgaccatgaatgagaagggggaaagagagatggacacaatatcggtttcgtctgctctacagattgcaggaagagcaggaagatatggcacccaatggcaggaaggttatgtaacgacattcaaagaagaagatctaaaaaccttgaaaacacttctggcttcacaacctgaacctatatcacaagcaggattgcatcctacgtcagaccagatagaactttatgcttaccatttacctaattctggtttaagtaatctaatggatatatttgtaactttatcaacggtggatgattcgttgtatttcatgtgtcaaaccgaagattttaaattcctggcagacatgatacagcacgtcccgctacccctaaagtctaggtacttattctgctgcgccccaataaacaagaagatgcctttcgtctgtactatgttcttgaagtttactaggcagtatagtaagaatgaaatgattacatttgactggttgtgcaggaatataggttggccgttgcagccccccaaatctattattgatttggtgcacttggaagctgtgttcgatgttttggatctctacttgtggttgagttatagattcatggatttgttcaacgaacctgatctggttagagatatgcagcgagagttggaccaaattattcagcagggtatagttcaactcacgaggttgttgaggaattctgagactggaattagttccggaacggctgtcattgatgatgatgaattttcaatgaaaacagaaaagcagacgtatttcagaggtcaaaagtcgtcggtcattggcagaggaagattaactgaacgcttactggctcaaggtatattaacaccaaatatgttacaagaactgaagaaagagtggaatgcgaagacaaacactgataatttgggggaaaacgtaggtgatgatcctaagaagatacgaaggaaaagaaaaacaaagt

SEQ ID NO: 565 - DNA, 1509 bp, Leptinotarsa decemlineata
  Annotation=CG3862-PA-like protein; Tribolium gene name from OrthoDB database=TC012311; Blast E-value Tribolium Gene vs. Leptinotarsa Unigene=0
gaaaaaaatgtttaataataatcagtacagaaactatgtcaataataaaattcaaacgtgttttttctgtttttcctaggaaatatcacagttcatatgaacggtttacaaattgctatggaatggtcaattccaaaaagagcctgggaaacaaaacctcctattgccagcttcagcggaaaatactgatcattctgatgtcccaaacctaagcatccatgtttatttctaccccatataaataaatcaccgctatttgttatagctgcggaatggtacaatccacaggcaactttttctactctgctctctggtgagaaatcattctttccaaataaagtttctggtatgtgaattggctccttggactgctgagcctgtggcccagctcccaataggccataaccccatgagaaaacttgtccgtcatcatttgatactatacaaaaagatccagcgctagctacactctggatttttcctaatttatcaagcattttgatatgccttgaagctgaactttgttgttcccctcctggtaatgacatctggctgtattccgagtttccccatccgaacacctcgcctttatcattaagagctaaaacaaaatctgatcgacatgaaagttttacaattttttctgattcaatatctccagttacacgagaaaattcagaatgattattgaagtggccaagtcctgtctggccgtcagcaccccatccacaggaataaacgcttccatcttctgtaagtgccatactgtggtcttgtccacattcgatatcaattacggattttccatcaatcttcgggatatgatgtatgtaacaattcattgtataattttcatctggtattattttccttccacactgaccaaaagaattgtttcctaaggtgaatattccttcatctgtcagtacaactaaatgtgcacgtcctgcagaaagtttgagtacttttgatttttcagggttcttgaatggcagggaaattggcttcgggtagaagagaatttctaagggtttgccatgtctgacttcatgataccctatttgtgaatcagtattgatacctgttccatagatcttttcatttgtatcgctattcacagcaaaaactgtgaaaccaaatccacttgctgccgtgatgacctcaaacttctcaccaaatcctaatcggtttggataagtaatacagaactctttttttaaattattatgtgatgatctgaagtgtgggatgcctaaagccccagtatagatgtttccccaagaaaatactcttctgtatgcttttttactggtggcatattggaaaactggcaatttctttgctgcttctggatctactgggtattttctcctgatcttacacatagatctactgaattttgataaaagcggcagtattcttttagattcattcattttcattatatttcaaattgtttcaattcagctatcataacatttttcatattatattctatttatttaacat

SEQ ID NO: 566 - DNA, 1408 bp, Leptinotarsa decemlineata
  Annotation=PRP38 pre-mRNA processing factor 38 domain containing A; Tribolium gene name from OrthoDB database= TC009710; Blast E-value Tribolium Gene vs. Leptinotarsa Unigene= 7E-122
gacatgtagtcgttcgtccgtcatgttgtaattattgatagtacttaaagtaattacaaagtttttattagtatattctgtagatgttatgaagtcaacatttaaagaaagtagactataaacgttatagtttacgaaaaaaagaaatggctaatagaactgtgaaagatgcgaaatccattcatggaacaaacccccagtatttggtagagaaaataattcgttcccgcatatacgattccaagtactggaaagaagaatgtttcgctcttactgcagaacttttggtggacaaagccatggaactgagatttattggtggcgtttttggaggaaatattaaaccaactccatttttgtgtttgacactcaaaatgctgcagattcagcccgagaaggacattgttgttgagtttataaagaacgaagagttcaagtatgtgagagctctgggagctttttatatgaggctcactggaacttctttggattgttataaatatttggaacctctttacaacgactacaggaaactgcggagacagaatcgccaggcacagtttgaattgattcatatggatgaattcattgacgagctactcagggaagaaagggtatgtgacgttattcttcctcgcacacagaaacgacatgttcttgaagaaaataatgaattggaacccagaatttctgctctggaagacctgttagatgaggaaatcgaattggaggacgactcgaagtatgatgtggtagagacagcaccaaaagaggagaagaaacgaaaaagagataggagtcggtctagagaaaaacagcatagcagggataaacataaaaaggacaaagagagggatcgtgaaagagacagagataaaagggataaagataaggacaagaaagagagggacagagataggcgtgacaaaaaaagggaagatcgaaagaaaagatgaataaattttcatctaattgggctcatattcttttatattataagttccacgttccaaaaattttttaatgttatttttttttcaagggcatatttgatagatttttgaaaaatggtactggttttacttggcacaatttttattttccaatattaacatgttcaaaaaggaaatatttgggtgcaatcatttatatggcattaaaatggaatatctaaatattcatttcatctgaaagtttttgctgattgtcactatatttgttgattttgtactattgcattttgcatcgacctgctggtattatacatgttgctgttaatgtgttgaatatcatcattgattttgtagaatcccagataccactgaaaagttatagattgtgggaaaagaggcacaactatttaatcctcgtaaataccacactacctgttaactacaaaaaatatgag

SEQ ID NO: 567 - DNA, 1207 bp, Leptinotarsa decemlineata
  misc_feature (1087)..(1087): n is a, c, g, or t
  Annotation=Vacuolar protein sorting-associated protein 35; Tribolium gene name from OrthoDB database=TC007463; Blast E- value Tribolium Gene vs. Leptinotarsa Unigene=5E-61
attgtcccaagtgtctatataataggtaacaaaataattgaaagtgaaagtgaagtaaacaagtagatgatgtgactgtgccatgaaagttaaactaatattaactcacttgtgaatgtgtttagcagttcaggaatttatttagacaacttactgggataatcgcacaaaagaatcgaaataacgatgtctatggaagttgagaccgatcatgaacgagctgatgaagctgaagaagcagctgttgctggcgaggagaacatagattgggagaaagatgaaattatcagtttcctaacgtacaaccaagaaatttgcttcaaaaatcaacagaggtgggaagctgatttgacaatccacgaaaaatatgagattgctctcaaactgctcaaagagaataaattgcaatttctaatgaaatttggaaaatacttgaaacaaaatcaattggggtacttcgaacaattcaccaaaaatttcgagccagattcgatagaaatcaaagtggtactcgatgatctttatgaaagttcttcggaaaaaaaattcttgtaaaaaagtaaagaatcgaagattcgaggctttgaaggagatggtcgaaaaaaaaatcgtatttttctgaaatagaaatgatgaagcgaaatcctctcttatacgaacaacttgttgggcagtatatgacagcagatgaggtcaaagaacgggacaaatatgtggagggagaacaaacgcttgtgacaatattaatggagggaattgaacgacaagacgttgaattatccagaaagaaacaagaagaaattgaagacagtcaaatggaagaagaagaagaagaggacactccagatgaaagtgatagtagaccacctactccgattccatcgacatccagatggggggaatttgaggaggataaggtatatcgacccaaacccaaatctaaaccgaattatgtgagcgcaacggagaagatactcctccaaaaagaatttgtgtcatcaatgtatcaaagttttttagatggtaacgataaggaatttgattatgaaactgtcgataataactcgttatatgataatataaaggngatggataacgacgcagaagagaagtactttgctacgatgatgtggaagataatgaacacgttgaagataatgtggagagttctgaagatgaattggacattatatggatagcattgaat

SEQ ID NO: 568 - DNA, 580 bp, Leptinotarsa decemlineata
  misc_feature (500)..(500): n is a, c, g, or t
  misc_feature (546)..(546): n is a, c, g, or t
  Annotation=Putative uncharacterized protein; Tribolium gene name from OrthoDB database=TC010500; Blast E-value Tribolium Gene vs. Leptinotarsa Unigene=4E-13
ttgtaattagtggtaaaaatatttcagtcactttgttgcaccacaatgatgttgttttgttgtaataatagatcataccaactttttgaaacgatcaaaggaagtagtcttgactaatgggatatcaaaatattcaccattggtattgtttctacaactgaaaaaatattttttttgggaaatggaggcgagacagataaggatgatttgccttctgaatattttgagatcctggctacgacgttttggtttcacgaaactcatttaccgaaaaaaatgttaaactattttgtttctacgttggagatatgaacatgaacgtatatacatttttcccgatcaaagtgaatgtcagtgtacactgatcacaccgttattgttgatcagtacatcatccccggatgcattccatttcctctctggaagaagacgttggggttactgctcaacgtgggttccagagtctgtaaacgtttccatcgtccggacggagaaaaacnccacctcctcctacggtatgacagtctgctgatgcttatgagaagntccgtactggttcagcccatacttaaccggcttg

SEQ ID NO: 569 - DNA, 1851 bp, Leptinotarsa decemlineata
  Annotation=Alanyl-tRNA synthetase, mitochondrial; Tribolium gene name from OrthoDB database=TC010044; Blast E-value Tribolium Gene vs. Leptinotarsa Unigene=0
cgtgtctctaattatgaagaggaagtttataaatcagtgttcgagaatccagttcaaaagtctggcaaaaactcacgatagaaaatccaaagttacttgaacttgatgtcatcgaaactccaaatttcataggagcctacaatgaaatcgcaaccactcgtccgaaagaaataggctcaaaattagctttcaaactgtatgacacctttggaatagatgaagatgccatagcaaagctgtcaaaagctttgaacttgaagttcaacccacaagagctcgtcaaagagttagaaactgccaagataagatcaaaggaaagcagtgcttatactgagaacaagatatactctcatctactcagtgaaaacatcccaaaaacatatgacacctcaaaatactcttattcaaaacacaatgggaaatattcctttggcgagattgagactactgttctcaaaatattcaaagatgaagaaagcactgatgaaataaaaaatgatcattactgttctttggtattggaccaaactaacttatactcagaagctggaggtcaaatatctgatagaggaattattacattgggcacagacacgttcgatgtaacatcagtagaaaacgtaaacggatatattgtgcacaagggttttttcagatcgaatggaaacactttgagaacaaacacaaaaggaaaaattcgagtggacgataacttcaggctttgctgcatgaggaatcacacttgcacgcacttgctaaatgctgctttgaaaaaaattaaaggagctacttgtcaaaagtccagcaaagtaactgacaagtatttgacttttgatgtggcgattttcggggacaaattgtcacataaggatgtagaaaaggttgaagctgaagttttggaggttttgaaaaaaaatcagcctgtgaatgtcatagaagtagacagccaaggattgctagcatttgattgcgttacacttattcctggagaagtctatccagaaagtggcataagaatcatagaagtgaagaatgattcatttttgtcaagggaaccctgttgtggtactcatgtcttggacacttctgacttagaggatttttgtatagtaaacataaaatctttaggaagaagtatcgcatcaatttctgctgtaacaggcgacagagcaaaattggctagagaaaatggatctgagatagtagaagaaatagattccttaaaggttaacatcagcgataacatagacaagccagagttattggaaatgatcgtaacaaccttgaggagaaaattgaattataatgtgggggatgaatctattttgcctttgagtgtgaagtttgactgtctcgaaaaactagaagctattaataaacaaattaaaaatgtagtcaaagaaaatttgagagatttcatagaaatagaaatgaagaacgccctagaatccaatgtgaagaccacaaattcaaacaaaagatacattattcactaccttcgaagttcgatgatgctggaaaacgtgccactacaaaaagcaacgaaactttgccctgatcttcccattctagttttagcatatgccgataatatggtcaaagctaggtgctgtgttcctaagaatctgaagactgaaaaattcaatgcagagaaatggatgaaggaaactgttgccgaagttttcaaaagtagggcagcaccccctaaaggtcaagacggtagtttagtttgcaacatgaaggctaaaaaagttcacgttcaagaatgggatccattgctcaaagacagtttagaaaaagctgagaagtacattaaaggaaaaatttgtagaacaatttgttgaaatatga

SEQ ID NO: 570 - DNA, 1854 bp, Leptinotarsa decemlineata
  Annotation=Novel protein (Zgc:56068); Tribolium gene name from OrthoDB database=TC001263; Blast E-value Tribolium Gene vs. Leptinotarsa Unigene=9E-145
gaaattaaatgatatatttgtgcatatacatataaaatgataaaaatcttgaaaagcttgaatatggaaaacattatataattttgaatttgtaactgtgttgtaaaaatacatgtttggattttttgcacaatacaatatgtaaaaaaaaatacaacaatgaaccatatattgaaaacctttcaatacccatattctactacaattaattacaaaagggtacaaataaatttgtataaattaaatacaagtgataaaatgtgaattttaaagctgcatatcgtttttacaatactgtctaatctttggcttatatggcaaaaagtcaacttccttacataataatatggagcaatttttcaaagatttaaagacacctaactagtaaaataggtgtttagctacacattgaataggaaccattgaagaacttcatttttattttttctataacttaaacaatattttgaggatagttacatcaggttgtctagcataaaattttggatgcaaagtaatctattgatactccaaggtttttgtcttaaaatacagtttatcgttgaaatgatgcaactcaatgttcatcaatgtatttctatgaatatattatgccaatgacaaaagtaattaaaatttccaggaaacctttacgatgaatcaaataaacttacagttgtcaaaatgagtaattacatgtatacataaatctgttgaacctttatcaactcggtgcattatgaactgttgtctctccagttaacgtatcagttaggtaactaattttcaaattacgcgctaaatgctgcttttctattggactatttacactccaagcaattactctcacacctttgtctcgccaatccaaaattacttcgccacttatagcatccttgtgcaacaaaattgttgataatcccaatatgtaatatataatcctgggtactgcccatgctagtaaagcatctagcgaacacaacaaataatatttgaacacggcttcagtcctcttattcccctttccttctggatatttgaaagaatcacgcgaaaatgcatatggtctatatgagagtgaaccaacaatttctggattgcctcgtcgaatccaatatatgatattcggaaaaaaggaggtgactacagcccttgaaaccaattcggggtactttttaaaaagttcttgaataactccaaccatcttataattattatctttaatatcgatgaacattctttggccatcagtgagtaattgttgaacagtctgctctagtgttgggattttagtatttacaaacctctccttttgagaatgattcactgaaatatcaatgttagcaaggtcttcccatgttgtgtcaccaacaattaaattagaattggccattctttccaaagtgttgtcatgaaatacaatgggtaccccatctttggttaaacatacatcaaattctattgcatcacatcctttctgattgcacagtttgaaagcagctaaactattttcaggtgcgtctaatcctgctcctctatgtgccactgttttcattacatattcattactggtagtctctaaatgtggatctttaccaagaactgcttctacggcgctgggttctggaggagggacccttaaaactactaacaaacaaactattgctgcagtgaatataacggtaaatggtaaaatgctacagaaaatttctttaatgagaaaccaactgccataagtcacataaattattgttatggcacttggtattaaattcaaaaaatttaacttcatggttttgactgtattggacaagaatttttatttttacaaagttgtcaatgtcaatattcaat

SEQ ID NO: 571 - DNA, 1492 bp, Leptinotarsa decemlineata
  Annotation=Putative uncharacterized protein; Tribolium gene name from OrthoDB database=TC011163; Blast E-value Tribolium Gene vs. Leptinotarsa Unigene=4E-66
gataaccaaaattgatatattattatatacatgtttattttatttagagatatattaatgaattaaatattgagcggtatgagttggtgaaaatattcacgattttttgttgctagccttattaaaaatcctcaatcaaatatgattgtgaccttactatataataaaatcaaatcatttattttgattttcaccaatctcttcagaaaagccttatgttgtttccgaagacgacgacgacgtagtagttgtgattctgttcccctcactcatgttatatccaacatcgaagaacaaaaacatgagactgagaactggggcaactgggaagaaggcttacccgacaaaccaaaaactgttcaggatcatattgaattgtaccgaaaacaaactcaaattgctagaactgactcagaatcacctgacactgaagaacagttgaatttctttgaaaatatgactcccaggattaccaaacaaacaaaagttttaatcaacactgatgaggccaaaaataatactatggacagattgaattttgtagaaggaacactaaatccagtacccacttctgaactgagggaatgggaagagagttcgggttgggaaaatgaaactttagaacatgaagcacaaagagtattgagagaaaagaaacgacaagatagggaaagaagggcattagaacaacaacaaaaacgtcatgaaaaaatgggtaggccattgggatctagattgagcacataaaatatgtagccaagatgaataactcaagatttttacctcaaatttgaaagttatttttaattaaaatgattcaatatggtccccccaaagaaaggtctagctttaatatatctgttggatgaaaatctgactggttattgtttgactttaactatgaaatgaattatgaaccattagtttttgatagtgaagaaaaaagtgaacgttcatcattacttaaaaaaaaagtggatttatgcactaatttcaaatcgtatctggaacctctgttataaaataacttcaaaacaaactctgctcccgcataccagaacttcaacactcttctcaatgcaggattcaccaacccatttggcgtcaccaagagatgaaccatactatttcctgataacgccaactcggttggtgacgcgcgtcgggaatagtgttgctgttctacaatttagcatacagttttatttgtattatatcatatgtagctagttgtcgttgaacagttgattttcattggcattagtcatgaacaagtcataaaatttcaatagttacaaatggaaaacataaaatgttatgacttgaaactgatgcatgaattcatttttaggaaaccacaatccaatgataatcagtcaattcaaatgtacttactgactacatttgaattcattttcatttctctaataatttttttttgttttaaattagtgagaaaaacgaccaatgaaaaaataatattttctaaaac

SEQ ID NO: 572 - DNA, 1943 bp, Leptinotarsa decemlineata
  Annotation=Probable methylcrotonoyl-CoA carboxylase beta chain, mitochondrial; Tribolium gene name from OrthoDB database= TC010120; Blast E-value Tribolium Gene vs. Leptinotarsa Unigene= 0
ttaatgtgaccttcaaatattttttatctgacagtatcactttgtttatttaaacatcagaaagtattcctttctgaatgttgccaattataatttcatttttttataattcctttctggctgttaaatggatgtttcaagaaatgcaaactgtaaagaaatttaattcatctagaatattcaacaaaaatcacattcggaatactccaaatgacgtgttctttatttccctgttcaaagctgctgccaggctcaatcccaacacttttcttgtgtccttgggatcaataactccgtcatcccagatcctcgcactgctgaagtaaggagacccttctttgtcgaacatttcaatgatgggtttctcgaactctttcttctgttgttcgctccacgactttccgtgactcgccacttgggataagactccagcagcttggggacctcccatgacagatatctttgcgttgggccacatgtagaggaatctaggggagtaggctcttccacacattccataatttcctgcaccataagaacctcctattatcacagttatttttggaacgttggaacaagcgacagctgttacgagttttgctccgtgttttgctatgcctcccgtctcagcttgtcttcccaccatgaatcctgtaatgttttgcaggaacaccaaaggcaccttcctctgcgtgcacagctgcacaaaatgcgcccccttcatagcactctccgagaatagcacgccgttgttgcctataactcccactgtcttcccatacagcttcgtgaaaccgcatactagagtctcgccatatttctttttgaactcgtcaaacttagacccatcgaagaccctcgcaatgatttctcttacgtcaaaaggcttgtggaggtcgtgatctacgatcccgtacaggtcgtcagggttgtagaggggaggttcgaaaggttcgtcgaaagatgttgaggatgtcctgttgaggtttttgacaatttgtctggccaggtggagggcgtgttcgtcgtttacggcgtagtgatctgtcactcctgaagtggtgcagtggaggtccgccccgccgagatcctcagcagatacctcttctccagtagctgctttcaccaatggtggtcctgccaagaaaatagtcccttgttgtctaacaatcacagactcatcagccatcgccgggacgtaagctccccctgctgtacatgaccccataacaaccgctatctgcgcaattccttcagaagacatatttgcttgattgaaaaatatcctcccgaagtgatctctgtcggggaacacctctgactggtggggcaagttggctcccccgctgtccaccagataaatacagggtagtttgttttgctgtgcgatttcctgagccctcagatgtttcttgaccgtcatggggaagtaggtgccgcctttaactgtagcgtcgtttgcaacaaccatgcattctcttccatgtatttttccaattcctgttacgattcctgccccgtgtatttggccatcatacatatcattagcagcaagagttgacagctccagaaaggcactgtttttgtcgagaagcaaatttatcctatctctaacgaatagttttcccttagccgtgtgttttttcagtgctttctcactacctcctgctgaaatagtccctgttttccttctcaaagtttccacaagctcaaccatacgttcgcggttttccataaactggctagattgcacatccactttagattttataatgttcatagatgtgtgaagatttttaaccaccaacaggtgtttaaggattattttaggcttagaaaacatttcttctattcaataccaccgttaaaaaagaatacacactgacttcattatcaagtaacttttgaccctaagcatataaatgataattctggaaggtctc

SEQ ID NO: 573 - DNA, 3100 bp, Leptinotarsa decemlineata
  Annotation=116 kDa U5 small nuclear ribonucleoprotein component, putative; Tribolium gene name from OrthoDB database=TC006019; Blast E-value Tribolium Gene vs. Leptinotarsa Unigene=0
gaatactttttttaaaggttatgttgtcttgtagtatttttcggctttatggttaatatatgaatattttcaaataaaagtatatatagtgtgcttcgtaattatttttgtctccagtgttagaaatattatatcgtcttttaaaaatggatgcagatctttatgatgaatttggtaactatattggacctgaattggacagtgatgatgatgaggaagaggaacaagaacagcttgatgataatgaacgtgaagaatatgatgaagagcaaatggaagatgatccccagccaatggctatcgttcttcatgaagataaacaatattatccttcagccttacaagtttatggtcctgatgtggaaacgattgtacaagaagaagatgcacaggctttagatgtaccattggtagaacctgtgaaaaagaaaaagtttcaactgaaagagcaggatcttccggagacggtttacagtatggaatttttggcagatatgatggataacacatcactcattagaaatgttgctctagtaggtcatttgcaccatggaaaaacttcttttgttgattgcttgataaggcagactcatcctggttaccaagataatgaggaaaagaacttgagatatacggacattcttttcactgaacaagaaaggggatgttccatcaaatcaattccggttactctgttactgcaagatatcaagaacaagagttatctcatgaatattttcgatacgccaggtcacgtaaatttctctgacgaggttactgctgctatgagattatgtgatggtattgtacttttcgttgatgcagctgaaggagtcatgttgaatacggaacgtcttctgaagcacgctgtgcaagaacagatgcaaataaccatatgcatcaataaaatagatagacttattttggaactcaagctacctcctcaagatgcttactataaattgaggcacattgttgaagaaataaacggtctcctcacgttatactcagatgatgctaatcctcacatagtgtcaccagtactgggaaatgtttgcttcgctagttcacaatatggtgtttgcttcaccctcaagtcatttgcaaacatttacaatttatacaatggggaagtcaacgtggaggagttttccaaacgtctctggggagatatttatttcaataataaaacccggaaatttacaaagaaagctccccacaactcggctcaaagaagtttcgtagagttcatattggaacctctatataaaatatttgcccaagtaataggcgatgtagatggttctctactggatgtcttggacgaactcggaattaaaatgactaaaaacgaaatgaaactcaacataagaccgttgctgagactggtttgtggaaaatttttgggcgacttcaatggcttcgtcaatatgtgtgtcgagcatataaattctcctctggataacgccaagaaaaaagttaatcacatctatactggtcctaacacaagtaaggtatatgatgacatggtgaactgcgatcaggagggattgctgatggtgcacagttcaaagatgtatccgactgaagattgcacatttttccaagtacttggaagggtgatgagtggaactttacatgctggtacagatgtgagaatcttgggagaaaattatactctgcaagatgaagaagattccaggatactcacaattggaaggttgtggatttacgagtccagatataaagttgaactcaacagagtacctgctggaaattgggttctgatagaaggtattgaccaatctatagtaaaaactgctacaatcactgacttaacaatttatgacgaactttatatattccgacctctgaaattcaacacgcaaagtataatcaaaatagcagtagaacccgtcaacccatcggaacttccaaagatgttggacggtttgcgtaaagtcaataaatcttatccgttgctaaccacaagagttgaggaaagcggagaacatgtggttctaggaactggtgaattgtatttggattgtgtgatgcatgacctcagaaaaatgtattccgagattgacataaaagttgctgatccagtagtggctttttgcgagacagtcgttgaaacatccagtttgaagtgttttgcagaaactccaaacaaaaggaataaactgacaatgattgctgagcctttggagaagggtttggctgaagatatcgaaaacgaaaacgttcaaataggatggaacaaaaagaaactgggagagtttttccaaacgaaatacgattgggatctgctggctgctagaagtattatggcattcgggcctgataatacaggacccaatattctggtagatgatacattgccttcggaagtagacaaaggtctgcttagttctgtgaaagactcaatcgtccaaggttttcaatgggggacaagggaaggaccactttgcgaagaacctattagaaacaccaagtttaaaattcttgacgctgtgatagctggtgaaccattacatcgaggtgggggccaaattataccgactgccagaagagttgtgtactctgcgtttttgatggcaactcccaggctgatggagccatatttgttcgtagaggtccaggcgcctgctgattgtgtatcggctgtgtatactgttttggcaaaaaggagggggcatgtcacccaagatgctcctgtaccagggtcacctttatataccataaaggcattcattccggcaatcgacagtttcggattcgaaactgatttaagaacacacactcaaggtcaagccttctgcctatctgtgttccatcactggcagatcgttcctggggatcccttggacaaaactattgtaatcaggcctttggaaccccaacctgccactcacttggctagagaatttatgataaaaactaggaggaggaaagggctgagccaggatgtatctattaataaatttttcgacgaccctatgttgttggaattagcaagacaggatgttatgccaaactaccctcttttgtagataaaattacaatgagtatttttaaataaaatattgaactaacg

SEQ ID NO: 574 - DNA, 1705 bp, Leptinotarsa decemlineata
  Annotation=G patch domain containing 4; Tribolium gene name from OrthoDB database=TC009895; Blast E-value Tribolium Gene vs. Leptinotarsa Unigene=4E-74
atcacagaacaacggtgttctgtcgatattgttttatttttgatagttctatttgggtttcattttgcagctgattttagtggttatttgtatcatataaagtggtgaatacaaatattttaatgacaaaatgatataataaagagaacacagaagtactaattttcataatggattttgcccgcaagcaactcgaaaagtatggctggtctgaaggcaagggattagggaagaatgaaaatggaatttctgctgctcttaaaccaaaactaaaatttgataattcaggagtgggacatgatgctggaagacagttcacaaacaattggtgggaaaaactttataacaatgctgctgaaaacatcgatgttgaagtagatggaaaaaatgaggttaaaatgaaaattaaatctgaagattcagttgaaatatcaactaaaagttattcagtcaaagagctgaaaaagaataaaaatcttgaatatggttcttttcttaaaactgcgaagttaaagggtaataccgaggaacaatacgatactcctaaaatttataaaaatacaacagaattcaaacctctgactgatgatgaattatttgctgcttgtggaggaagaaccgctcataaaggtgctcggcatggtttgaaacttggcggaaaattgtctagaatagaaaaacaagaaaaaatgctgttgaaaaaaatgaaaaaagtttctctgtctgataatgaaacttctgacaaaataataactgagaaaaagttgaaaaaaactcaagaaacaaaaggaaaaaagggagaaatatactcccattgttgaagacagcatggaaagtatctcttccaatggtttcaaaaggaaaaagaaacgcaagagtgtttctttcaacgaaactgttactgttacagaaatttacggagatcacgaattcagttttgatagtgaagtaggttcagtaaaggacaagaatagtaatgaaccaaatttagaaagtattgctagcggatcagatgaaggcattgaacaggatatagaaaacaataataacgagcagcaagacaatcataagagttttgaagttggacaattcaacattagcgatctctcaaaagctgaacgaaagaaactaaagaagaagagaaaactagaagctaagaaaacttctgcaacgggaactttccttcagaaactcaatgatggcgttgatctcgaactaactcaatttgaggataaggataagaatttgaaaaagagaaagtttttggaagactttgaacagaatgatcacaaaagtgaactttcaaagactgactcgccaggaaagcacaaaaggaaaagaaatagggctaagaaaaagcaaaaacggatggaagaaaagcaaatcaactctattgtacgatctctcgacaatgtttgccgtatatctgaaagtgattcagttgaataggatgaataatgagtgtattttaggttactaggaaagtttgaggtggttctggttggaatttttgaaaatttatttgagggttttttgtacgattcaataaaatctatagtgatttatggaaaaaatacattactatttttgtattacaagcgacattacaattattcccaaaccaaactttaaaaagccctctcaacttgtttatattgtttataatgttattaatggtgattttctcaacatctgaataaagacc

SEQ ID NO: 575 - DNA, 4032 bp, Leptinotarsa decemlineata
  Annotation=Patched; Tribolium gene name from OrthoDB database= TC004745; Blast E-value Tribolium Gene vs. Leptinotarsa Unigene= 0
ttgccgatgattgtgcctgagtgtggctgccggaatcgtgtgcccgacgaggatggcttccatggcgccaccggagtcgccaacggagtctacagaaaggcacgagtcagatctttacacaagacctggttgggtcgacgcagatatcgctataggccaactggatcagggaaaggcccatggcgaccgtggaattttatgggttcgggggcagattcagagacagttacacacgctaggcaacattctcgacattcatgccgggaaggtcctcttcgtgagcatactggccatcgccaccttctccgtgggactgaagagcatgacttttcattccgatatcgaactgctttgggccgaaccgtcgacgacaccccagtctactcctgcagaattactttccacgcatcagatggtattgcaaacaagtatcgacccagatgtgaaacttcttcgcccccgtggcctccttgaacacttagcccttgtacaacaagcgacccaggttactgtgacgatgtttgatatcacatggcgtctaaaagacttctgtcaatctcctagtattccaaattttgatgcctactacatccagcagatgttcgaaaatatgatgccgtgctccattgcaacgccactggattgtttctgggaaggatcaaaattactgggtcccgaatatccagttaatataccttatataagtggaaacccaataaaatggacaaatttgaatcccatcgagttggtttcccaaataaaacggaaagagtcccactttgattaccattctttggaagactattttaaacgagcaggaattaccacaggttaccaggagaaaccgtgtctgaatccgcaagatccagaatgtccagataccgcccctaataaaaatcaaacgcatacactggacattggagcagagttaaccagcggatgctacggttttgcaccaaaatatatgcattggcctgaagatttgatagtcggtggcatgcagaaaaataaatctggtcatattgaagaagccaaagcattgcaaactgttgtacaattaatgggcgagcacgagctgtatgaattttggtctggtcattttaaagttcagcatacaggttggagtaaagaaaaagctacgactgttattcatgcatggcagaagaaatttgccgaggaagtggagcggttgtcaaagggcaaaagtgcatcgtcatcatatatcttttataccttctcaacagcaaatgtaaacaaaattctcaaggaatattcacgatcggacttagtaaaattaggtatagtgttgggttcgacatgtgtgtatggttggatagcccattcgggaatcgcaactttgggtgttctagtcttagcaagttccgcaacagctgcgttaggtgtttgtagcctcgtcggtttgccaatgaaccttttaagtactcatgtgttaccgtttataactgtaggactgactatgagagaaatgtttctcattttatcgacacatggaagaaacctttcaccatcagaagtgttacaaagaacggggcccagtattatttcatcagcacttattaattctggttcatttgtaattgccgcacttttaccgatacccgcattacgtgtgttttgcctccagtgcgctatcatgattgtgttccaaggaactgctctgctcataatgtttccatcctttcttgctctaaaacaaagatgccagaaagccaatgttccgtgttttcggtccgagaagtctcaagcagtgaacaataacaacaatgctgatgtggaacatggtagcaatttgcttactgcagagcaagtatgccagaaaagaaagagttttctgtcttggtgcatcacccgctactcaacttcaatattactgcagccttttatgaaggttgtgatatgtatttcttatgtggtacttataatattttgtatattcaatggactgaagttggaatttgatgtaagactgtcgacatttttacccaaaaatacacaagagtacaaatatttagaagcacaaaataagtttttcggaatttataatttttatttggttaccaccgagttggagtatcctttaaatcaaccacttttatatgaatatcattcttcccttacgaaagttcctcatgtattaaaagattccaatgggggcctagacatgaatgatttctggctctcaaattttcgggagttcctggttgatctccaacaggaattcgattacaacagaaaccgtagttgtctcagtagtgaaaagtggtttcagaatgccacagaaaaagcggctttagcgttcaaattattagcacagactggtattgtagagtttccagtagataagagtcaaatattcaagaaaagactggttaacgataacattatagattcaaaagctttttataattatctttctgtttggaatagtaacgatcaaatatcatataccagctctcaagctaatttaactccaaaacccttcgaatactatacttctaaaagtgaggttgatttgaaaatacccaagtcacagcctctaacttacactcaaatgcctttctatttcaaaaatttaaaaaataccggaagcattatctcaaccttgaaacaaataaaagatatttcagaagacttcaataatagagggctgagaaattatcctatagggcttatatttgcatattttggtcagtttctattatttgatagattgctagcagttcaatttattttaacattgacagctgccgcaactgtggcatgtgttcttatacagtggaccaaactatggtgtgcccttttcaatactttaatgtgtatgttattgttggccctaattaatattaatgcactcagtggaacaatgggggctttacacttcattattattagtcgaaacatttttttggttttcaccggatttttgagtgccttaggaagtcgtgaacgccgtgtaagattatctctggaaattaattctgaaccaattatgaaaggggatttggggttactaatatgcacatcagtgttagctacatctcagtttgaattcatacataatcatctgttttctctcattgtgttatctgtttgtggttctttaacaaattcatttgtatttttacctattttattggcacttgcaggaccaaaagcagaactccaacctatagagcactctgatagaatatcaacccctcctcctcccattccatccccagtgcccataagaacatctttttccaaatcctctaagcgaaacatgtcagctaaaacgacgagagaacccagtttgacaacaatcacagaggaaagttgtaatcaaagtattactgtcgaaccacaagtcactgtagaatatagtagtccagagtctagctctagtggcccattcactaccaaagttactgccacagctaatattaaagtagaattagttgcccctgtatatagatctagtaagtgtagtagcaagtgtcataggtcatttaaatgtgatcgaagaaaacgacaagaacaaaggcagcaatgccgttgttgtaaacaagactctaatagtagtgatagtaacacagaggctgaacaatgccctagtagctagcatatttcgttaccatgtaaggaatcaatgtaaaatatgtttatattgaatatatgtataccaagcgtttatttatttgaagacaaaccgtgtaagatagtaaaataactcaaatttttatgtacaaagtgggtttggaaaccatgtgcacaactttttgtatacaatggagtttcaaaactcattgtcattattagttagccttttcaagtccctggtcaataatttgtatcaggatttgaatttctatcagtatttgaatatattttatacttcatttcagattaaaacccaccaaagaatgcaaaaaacggtgcactggtcaaatttcactttctgtataatttttaaacttgaagtgaacaaagctgtgtatttgcacaaacacatgtataaaaatgggactgtca

SEQ ID NO: 576 - DNA, 1649 bp, Leptinotarsa decemlineata
  Annotation=GTP-binding protein 128up, putative; Tribolium gene name from OrthoDB database=TC005867; Blast E-value Tribolium Gene vs. Leptinotarsa Unigene=0
ggagggtgttctgtacgtttaacatatggaaccacagattaaatctgtgatggaacttagaaattaagagtgcatggaaaacgcgagtaatttttgttcaacttgcttttgaacgtttttcaatatttccttggaaatttgaaataaaatttattgaacatgagtactatattagacaaaatagcggctatcgagtctgagatggccaggactcaaaaaaataaggcaactgctggccacttggggttgcttaaagcaagattggctaaattaagacgcgaattaattactcccaaaggaggcggtggaggcacaggagaagggtttgatgtagctaaaaccggtgatgcaagagtgggtttcgtcggttttccatctgtaggaaagtctacattgctgagtaacttagctggtgtatactctgaagtagcagcatatgaattcacgactttaactaccgtacctgggtgtattaaatacaaaggagctaaaattcagttattggatttgcctggaattattgagggggctaaagatggtaaaggaagaggaagacaagttatagcagttgctagaacttgcagtttaatttttctttgtctagatgttttgaagccattacaccataaaaagctcattgaacatgaattggaaggatttggattgagactcaataaaaaaccacccaatatttacttcaagaagaaagataaaggcggagttaacttgaattgcatggttcctcaatctgaactagactcagatactgtgaaaacaattctctctgaatataaaattcataatgcagacgttacattgaaatatgatgctacaagtgatgatctcattgatgttattgaaggaaatcgaatttatgtaccttgcatttatattctgaacaagattgatcaaataagtattgaagaattggatgtcatttataaaataccacactgtgtaccgatttctgctcaccatcgatggaactttgatgatcttttagaaaaaatgtgggaatatttgaaattagtacgaatatacaccaaaccaaaagggcaactaccagattacaattcaccaatcgttttgcatgctgatcacatatctgttgaagatttttgtaacaaacttcacaggagtatagctaaagaatttaaatatgccttggtgtggggatcatctgtgaagcatcaaccgcaaaaagttggtttggaacatattctgtgcgatgaagatgttgtacagatcgttaagaaagtttgagaaagttctgatgacttgactgtaaaatatgcagatcatatggttgcaaaactatcacttatatttttaaatatgaaaaatgattcttgaaaggatgaaaatagtaacaattcactttttgggagaagtgtatctattaattacttatattcaacaaatattttttgaataatttttacgctatttcaattggaactgtatgcaactgtataattataagttttgggaaatattttctgcacggaggaaatgacatgaaataatgatgttaattacttttaagaataaattgaaaagttctcttttgttcattttacaattaacaaactaatactcttattcctaatcttagtaacaaatgaaataaattgaacaaataagcacct

SEQ ID NO: 577 - DNA, 1857 bp, Leptinotarsa decemlineata
  Annotation=Dnajc8 protein; Tribolium gene name from OrthoDB database=TC000514; Blast E-value Tribolium Gene vs. Leptinotarsa Unigene=6E-98
gacatcgtggctgttttgtgagcatgaacaaaaaatcttgacaaatgttcaagtattcttttatttgcaaatcaaagtgtttatgtttgtggtttctaattctagtttccaattttcataatactgttaaaacaaggtcattcgaggtttgatggaaaagtaacatagaatacttgtaataaaagtatattagtgacaaaatgacttgtaatattccactgccagaaaaagatacgaaattcaacgaattctacacagaggtgaaagaaattgaaaaacgagattcagtactaacacccaaacaacagattgagagattgctgagacctggttccacttatcgaaatttaaatccttttgatgtgttacaagtcgaaccagatacatcaatcgaagaaataaagaagaaatacagaagactgtccattcttgtgcatcccgataaaaaccaggatgatcctgacagggcccaacaagccttcgaagctgtcaataaggcttggaagacactcgaaaatgaagaaaccaggaaaaaatgtatggatataattgaagaggccgtaggaagaacagatattatgcttgcagagaaaagaaagaaagctaaaaaagaaggaaaagatggcataccagaagatgatcctgctaaatataaacatgccatttatgtcctcacaatgaaactctttgcagatatggaacgtaaaagacgtgaactagctgaccgtgaccaagaagaaagaaaacggaaacgagaggcagagatagaagatgaggaaaatgctaaagcacaaaaggagtggcagaaaaactttgaggaatctcgccaaaatcgagtcaacagctggcaaaccttcacttccaaaagcaaggacaagaagaccagtaaaaaaatcaaagtatttaaacctccgaaaaataagcctgaatcacgatcttaaagatttgtagaaaacagaaacaatataagggctagttattgtaattattatagtattaattataaaaaataatattttttattatttgataaactaatgcatgggaagaaactgtattgctttccctaattttgtgtgagtgaaatgaaaaatgtacaagagatgtcagaaggagttttctctaagtgtatatcagaaggtactttgagttaattgtgttttagacgtaaatagaatgaactttcaaagcagtgacacaaaaaaaaatgtctgaaaataaaagctagtgcgttgttatatatacctaatagtaaaacttcttatatagaatgatttttttttcgtactattgggaatttagttttgttttcatttagattagttgtgaacttttcattgtgagtttaattcgcaatttaattttagtgactttaattcactaaaattttttattagaatctcaattgattagccccaaaaaataatttggtgactttcatgtattacgaaatcatcatttttcaatcatctacttttttatctaaatgaaacatgagagttgctatataggtatatatattttcattatcataatgatctcacaaaattttcatgatgaaataccttatccttattttttgctcgtttagtcattactgaaaatatttggattttgtatgccaatgatgaatcaatgaatttgtatctgaacttaataattttttaatcccaaaaaatagaaagttttatgaatattcaagtaacacttcattgtgagattttcactgaacagttcataaaattgcaacatgtgtttcacttaatgaaagcttcctcagacgaatttataaattaattaatatgagtgatttctgatttaactcgttgtgacatgctttgtatattatatacatat

SEQ ID NO: 578 - DNA, 6486 bp, Leptinotarsa decemlineata
  Annotation=Probable ubiquitin carboxyl-terminal hydrolase FAF- X; Tribolium gene name from OrthoDB database=TC010455; Blast E- value Tribolium Gene vs. Leptinotarsa Unigene=0
atatcctccaaatagatcctgttcttctaacagaaagcgggatcaaatgcttcgaacgattctttaaagctgttaatatgaaagaagggaaactcaaagtgaaaaggagactattattgaccgaagatctggatctgataggtcttgattatctctggaaagtggtaacgctatgttccaacgatatcgcttctcgggcgattgaactcctgaaggaagtcagtacgaatttaggtcctagattgctgcagtcccagttggtgtttcacgaaacttacatcactgagtgttacgataggcttcgggctcattacgacacattgacaatattgcaaaagtctgtgaatgacaaagaattcgacactgaccaaatacagaataggattaaagctgaggctgtgaaaatgtgtagggtgatgaaagttttgcaagaatatatgagcgaatgtgacaatgcctttgtgggggaaaggaaaattttgcctctgcacagagcgtgtcacgggaagcacctcactctgattgtaagactatccagtcctaataggcaagtggaagacttggatctgtacactcactcgaatgatacgttagcttctttgaggaagtatatattgcgaaggatcaaaccagggatgcactgtaagttggaattgtttgtgaacggtgagcctctagatccagccgacgacagaaagttgttgtcacaaattcctataagagataaaatgctaatctccgccaaggtggtgcagataaactccaacatggcatcctcacaagatagtagttctgacagttccacgtcgtctcctcagcatccttacgacggtccaaacacagaagctgagagtttattacctggggttctcatgtctagccagtccgtctatgcgcagttcttttgccagctgatgaacgtgggaagtactctgacttttcctttgctgcgagatatgggacacacccttttgcagctaatgccctgcgatctagtgaccatagacaaactgaaggttctcttctcaactccaggcgaagataacattacaatggatagtatgttcttcagtgcctctcctgctgaggtcttgtataatttggaagtattgtattctatgttgatgcctgcattggatacgatgtcggagaaaacattcgaattccagtacacttttatgatatcgggggaggcacacaagtttttggaaatgctgacaaaaaacaatttcatgtccagcgcagataacaccacgcgtcgatcagcctacttggttgtattgaagatttgcaaactcattctgacctccgtggctcatgtcctggtgaggttaagtgaagatcatactcctcctgaaaatgaacctctcaacgagaatagcacaacacccggaacatatttgaggcaagctctgagaaatgtaccaggacactctgatcatttgttacgtcaggtctccatcaagttatctcaaagtttagcgcagctgatagtagctgaaacaggcaataccggccaagcgcaggtccttttcagtcaagccctcaactgggagctgccagatctagctacaactctggcgcttgtcaggctcgtttgggctgcgagcagtaacaacctgggagccctcaatgcatctccggaaaacttgcacgccctctctgatcccggcaaaatgaaaaacatggaaatagtaaacgacgatatactgttgtgtaaggaagctctggagctgctcagcactgcggtggtgctcaacccaagcagtttggaacacctctatcaggataattggtggccttatttcataactgacttagttctgatcaatcctaactgtgcgatccggattgctgctgcggaacagctgattataatatgtacttgtggcgctgccagtcgtttggcactacagctcatcatgccgttgctgttttccctcctcaacacattagttatcgaaaatgcgaatacgtcgcatgagtattttcaattgttgtgtcgactagtcaatgtggcgtacctaacgaactgtcccctttcgggcgtggagaacctgcaatccagtgaggtggcttggctgcggaaagccagagacaaacatgaggtgctcatcgaagggcatctgcttctggcaaaagaactgctgttattcatgtctctggagcagagatgtgagctaggtagtgcggaatcaggaagtttgataaaggaactgctggaagactttttgtttcctgccagtaaattgatgctgcagctgaacaagacgggacagttgggcgaggatccagccattcccatttgtgatacccctcaaacacaggcagctgctttcgacttgctcatcgctttatgtttgaattgtgttcagaattacaaacagctggtgaccatgctaacggaaatgttttattcggatcctgattctgcaataaccgaatgggactatctgcctgttgttggtcctcgccccttccaaggttttgtgggtctaaagaatgcgggtgctacttgttacatgaactcagttcttcagcagctctatatggtggagagcatcaaagagggtatcttggcagcagagggcgccgccaccgaccccaatgaagatttttctggagaggaaaggttagatgtcgacggggattgtacagacgaccggaactgcttagatgataaccgaaaagattataatgtaggcattctcaagcaagtacaagctatcttcggccatctggcctgttcacgccttcaatattatgtgcctagaggactttggagacatttcaaacttcaaggtgaaccagttaacttaagggagcaacaggatgctgtggaatttttcatgtcgctggttgaaagtcttgatgaagctttaaaaacgttgggacacgagcaaatcatgtccaagatattgggtggttcttactcggatcagaagatctgcaaagggtgcccccatagatattccaaagaggaaccttttagtgtgattagtgtagatattagaaatcatagtagtctgccagattcaatggagcaatatgtcaaaggtgaactattagaaggtgctgatgcgtatcattgtgaaaagtgcgcgaaaaaagttgtgactgttaaacgactgtgtgttaaaaaactacccccaatcttaggtattcaattgaaaagattcgagtatgatttcgagagggtgtgtgccatcaaattcaacgactattttgaatttccacgggagctcgatatggaaccgtacaccgtatccggactggccaagatcgagggagagataatagactgtgatttagatcctagtgccgacgacgtttgtacaaaatatcgtctctctggtatcgtcgtccattcgggacaagcatcgggtggacattattattcatatattagaagcagagatccttcaggggaagtgaggtggtacaaattcgacgacggagacgtgtccgaatgtagaatgggagatgatgaagaaatgaaggtgcagtgttttggaggggattacatgggagaagtctttgatccgatgttgaagagaacgacgtacagacgacagaaaaggtggtggaacgcttatatgctgttttacaccaggcatgatatcgaggaagaagctgcactgaaagcattagatttgctgacaatatctggtacaagaaaagaaacccacctcaagatgccagtagcgatagaaaatagcataagaaagcaaaatatcaaatttcttcaccaccgcagtcagttctccgtagagtatttctctttcataagaaaattggcgaccagttgcactcagagtaatacaaggcacagtcagccgttatccaacgatttgttagaacagcagtacctgctcagtgtgcagttggttagtaattttctgttccatacaggctggcatacgaagaaaaacttacgaggtcctgcgatggaatggggtgacgtactgtgcctgcatcttcgaacttctccggtgatacgttcctggtttgcccagaacatgttgttcagccacatgggcaggttctgcgagtacctccttagctgtcccagtaacgaggtgcgctccgccttcataaagattgtcgtcttgctcgcccatttctcgataaacgatggcccttctccggcacctgcggcgttcaacaacaacgacatgacggcttctctgagcgatcacatcctctgggcgttgctcagtcttttacagagggaggttagcgaacacggaaggcacttgccacactactgcactgtgtttcacatgtatgccaatcaaggtattcaagaaagagctcaactactgaggatgaacgtcccagcaacgttcatgctagttgccttagatgaaggtcccgggccagccataaaatatcaatatacggaattaggaaaattgaatcaattagtatcgtgcctcatccgatgttgtgacgtgagcatcaagtgccagtctagtaacggaagtccggttttaccaaatccataccgagatcctgtctgtcaggagtatatcatgccaatatcaccccaagctgctgatatcttgttcaaccgtacaacgtatgtaaagaaggtgattgaagacactaacttaacagatgaagccatcaaactgcttcagttttgttcgtgggagaatccccatttctccagggtagtgttatccgaacttctgtggcaaatagcgtatgcatactgccaggaactcagacaccacattgaaatattgttgtcaattctgcttatagaagactcttggcaaactcatcggatacataatgcaatcaaaggtgttcctgaagaacgtgaaggcctgttagaaaccatcatccgtgcaaagagccactaccagaagagagcataccaatgtataaaagcgatggtggcactcttcaacaggtgtccggccgctcattctctgctcatgcgccaggcagatgtccgcagatcttgggcttcatctgtcaattggctgcaagacgagctagagaggaagtaccctcccaacactcaatattcgtataacacatggtctcccccggcacaaagcaatgaaagctccaacgggtactttttggagaggtcgaacagcgccaggaaaactctggagaaagctttggaaatgatgccggaaatcgaaagagaagaggaagatgtcagcgaagaccagatttcgcaagaggaagcaccaccaccttcagatcaactccagcaagaggaaagcaactctgaacttccagatgtgacgcaaagctgtgagaataacccaaatacctaaggtagcaattgaaggcgaaaagagagttcgtcgcccgcttttcatttctatataaagctttaagcgcctcttgcacttttggttgtcgacttcattttggagagaggtatatatatttatgaggacggaaagaggaacatgtgatatgtatgtatataaaatgtaacttgacgcattttctgaatttttatattgactgggatgcatttttcctaaacatgttccttaccagtagtcccgagcgttcattttgacgtgtgttgagaggatctgtccggagaaatgtaaataaatatgcgtattaccacagtcgtttttctagttagcttttgtttttatcagaaaataaacggactctcaaagtcgatgcagtcaacatgtttatacaattgcttttttttttagtaactagtgaaagtttgtctttaacataataagaaaattcagtgtaaatatctaggaaaactatatgaaattgtgctctttgaatatttatgttctgggcgtttcttagctgacagaagaacaaaaagaaactttgtaaaatggaagcgatcaacaaaatagtttttccgacagtcgtacatttcaatatatttttattttaaacaataatttaaggaccgatctagcagttgataaattgaatttgtttctcagtgatttgttataacagtccagattgtgttgagttgggagagggaaataaaaacttctgtcagctcgttaccaacccatcggacattacttgattttgtgataattttctgtaatataatttacatctaaagtcataactcaatttaactttatattttttataaggtatccttattttataccaatacctgtatatatttacgatgaccattttgaatcttgtcatatatttttttttaattaacgagtcactttgttaatttatatatattagaagtttatgtacatacataagtactgtaatttgtgagatatttgttatgaaatttttttcgttaaattccgttatggctttaaataagcagaaccagattcgttgatggagtcgttggtttattgtgttctatacgtgtaaatggcacatttatttatttaatgaactataatgactgttgataaatcacaaaattgtttcccccctatttatgttgtgtattttgtaggctagactcggagggaacttgta

SEQ ID NO: 579 - DNA, 2635 bp, Leptinotarsa decemlineata
  Annotation=Putative glycogen [starch] synthase; Tribolium gene name from OrthoDB database=TC015651; Blast E-value Tribolium Gene vs. Leptinotarsa Unigene=0
tctgtcatcaggttagagtttcgttatagtggttagaggtgaccttcattaggtgaattgttcaaatccgtatattttttaacaaacttctgcttattttgatattgttgtattatattttcttgaaatttcgtataaagaatattttgataaagaaacaactttgtgccaataatttgtgcgatgtccagagaaagagcttcgagacggttctaccgtgttgagtcaatgaataaccttctatcttgcttagatcgtggtatgactgcagaagaacaaaaccaatggtctttcgaaattgcatgggaagcagctaataaagttgggggtatttatactgtcatcagatctaaggcatatgtgtcaaccgaagagatgggcgatcattactgcctcataggcccatacaaagaacattgtgctagaacagaggttgaagaaggcccacttgcttctgaacccatgaacaatgcagttgaagtactgagacagaacggtttcaaagtccataccggaagatggcttgtggatggaaatccacaaataatcctgatggatatcggatcggcagcatggaagttagacgagtataagtctgaactttggagcaaaactaacataggggtaccccatttggatgtagaaacaaacgatgctattattttagggcatatggtagccgatttcatcgcagagtttaggactaaagctgaagaatatgggcagggtgttccaccccgaattgtcacacactttcacgaatggcaagctggggtaggtctcattgtactgcgtactagacatgttaatgttgctaccgtattcaccacacacgccactcttttaggaagatatttgtgtgctggcaacaccgatttctacaataatctcagtaagtttagcgttgatgaagaagctggaaaaaggcaaatttatcataggtattgtttggaaagggcagccgcacatttaggccattgcttcactactgtttctgaaattacaggctatgaagcggagcatttgctcaaaaagaaacctgatgtgattactccaaatggtctaaatgtaaagaagttctctgccttacatgaatttcaaaatttgcatgctctttccaaagaaaaaattcatgaatttgtgcgtggacatttctatggccattacgacttcgatttagacaaaacactttatttttttattgctggacgctatgagtttggaaacaagggtgcagacatcttcattgaagcgttatcaagactgaaccattatttgaagtcaactcatcctgatataactgtagttgctttcatgatatttcccgccaaaactaataatttcaatgttgaatctcttagagggcatgctgtaactaaatcattaagggataccattaacgaaattcaaaataatataggaaagaggatgtatgaggtgtgcttgagtggtaggttgcctgaaggtactgaactattgcaaaaagaagaaatggttcgtctaaaaaggtgcatttactctttacaaagggacggtttaccacctataactactcacaatgtgaatgatgattggaatgaccctgttctcaattctgttcgaagatgtaatcttttcaacacaactaatgatcgggttaagattgtcttccatccagagtttctgagttcaacaaatcctttatttggcctagactatgaagaatttgttcgaggttgccatttgggtgtttttcccagctattatgaaccctggggctacaccccagccgagtgtactgtaatgggcattccaagcatcacaacgaatttatcaggatttggttgttttatgcaagaacacatcacagatcctatgtcttatggcatctatatagtggaccgaaggtatatttcagtagaaaattctgttcaacagctagcacaatacatgtacgattttgcaagacttagtagacggcagagaattattcagagaaatagaactgaaagactcagcgatatgttggattggagaaatttaggagtgtattatcgtcaagcgaggatgaaggccctacagagcgtattcccagattacaaggaagaagaagaatatggaattagtactttgaggtaccccagaccactctcagaacctccatctcctagttcaagtaaggttacaactccggcagcttcattgcatggttccgatgatgaaagtgattctgttgatgaagaaggagagctggaagaactgggaattaagtaagaatatgaaacagtttaggaaaaatgttttaaaataataattaaaaaaagtcttaaatttacaaattttaaaaatatatataattgttataaatttatcactcattagaaattgaagtaatttatttctaccgacgtttttattttggtgttatatccatgaccttgttaataactccttctctcatcatgctgccaaaaagaaatatatggtcatgaaatgacttctctgtagtcggaaattctaaataactcaactcttgtttgtattattttttcgagttgtattattttcttacaagaaggaattatatgtattatgttaagaaaaaaaatcgtaataaaaatccaaaataaaaaaaaaaaaaaaaaaaaaaaaaaaa

SEQ ID NO: 580 - DNA, 704 bp, Leptinotarsa decemlineata
  Annotation=Vesicular monoamine transporter, putative (Fragment); Tribolium gene name from OrthoDB database=TC000945; Blast E-value Tribolium Gene vs. Leptinotarsa Unigene=2E-4; Blast E-value Tribolium Gene vs. Leptinotarsa Unigene=0
gtgacgccctgcttccaccttccagcccccatcgtatccatcatccaaatggggagagaaggttctaacatggctatgcccatgttggcgaatgttatggcaccagcagcaatgataatatatggatcagtcgccaactgcttcaaagaaggtggatcagactcttgtctgataactgctggttgtaacatcagcaactgtaacaatccatcacccagggctagtgctgacagtaccaggaaaggtgcagatttccccacaaattcatacatcacccctccgaagggcggcccgatcaacacccctagtgccagcccccctagagctatgcccatggcgtttcctcgttccttgtcgtctggatacctctctgctagcatacccattccagatacgctggaacacgatgagcctattccttgtagggatctcgctatgaacaggacactgtagctacgaccaaatgcgaaaattatagttgataaaaacatgatgaggaaccctgcaaacatgggtacactgtagccaattttgtgagtcagtggaccaacgaatggatttgccagtaactgcacaaaagccttcgaggcgaacattatccccacctccacagtttcctgcactaaatctttgtgacgtaattcgtccaccgcagcttctggatctagagttgtgtaattatcatattccgcatcattcaatgc

SEQ ID NO: 581 - DNA, 830 bp, Leptinotarsa decemlineata
  Annotation=Kinesin-like protein KIF16B; Tribolium gene name from OrthoDB database=TC008919; Blast E-value Tribolium Gene vs. Leptinotarsa Unigene=9E-67
gctcgctcaaagtgcgcgagcatcccaaaaaggggcccttacgtgcagggcttgactactgttctcgttaccaattacgggcacatccaagagtgcatggaaagggggaactcccacagaacgacggctgccacgaatatgaatgatgtgagcagtaggagccatgctatatttaccataacttttgttcaggcgggatattccgaaggagtttcctagagaaaccgtttccaagatccacctggtagatttggcgggcagcgaaagagcagactccacgggagcggtaggccaacgtctcaaagagggcgcccatatcaacaagtctctggtaactctcggttcggtcatatcggccttggcggaaattgacagtcgatcaggcgagtcgcaggaaatccgctttcattccatacagagattcggtgctgacttggctgctgaaagacagtctcggagggaattcaaagaccatcatgctggcagctatcagtcccgcggactgcaactatggagagactatcagcactttgaggtacgcgaacagggccaagaatatcattaacaagccgacggtcaacgaagatcccaacgtcaaactgatcagggagctgagggacgagatcagcaagttgagggctatcatgttctgcgagcagaggactgatatgctggcgcagttgcacgagaaggaagctaaggaaaggaactgacggaagaatggactggaaaatggagggaggctcaggcgatattgagagagcagagggcgttgggattgagaaaagctggtcccggagtcgtgctggattccgatagacctcatctcc

SEQ ID NO: 582 - DNA, 1522 bp, Leptinotarsa decemlineata
  Annotation=Nucleoporin seh1, putative; Tribolium gene name from OrthoDB database=TC009902; Blast E-value Tribolium Gene vs. Leptinotarsa Unigene=0
gataataaagctaacctttaaaaaaatcctgtacttacagtttgatgtttacaattttttgaaaattgtgtatttatttttgttccaattactgtactagttcatcataatactagtttttcattgagttttgttttatattctacgagaattgtcgataatatttggaaaaacggtaattaaataaaagtagcaagttcagtctccgaaaatgtttgaagctcaagaaatatatgcagaacacaaagatctcatccatgatgtggcctacgattattatgggagacgtatggcaacttgttccagtgatcaatatgtcaaagtttgggagcttcatgatggaaagtggtctttaacatctagttggaaagctcacagtggatcagtatggaaggtgacgtgggctcatccagagtttggacaagtgctagccacttgttcatttgacaggactgcagcagtctgggaagaaattgttggagaattgccatgtccaggggaaaggggcactcgccactgggtacgaagaactaacctagtggactcacgaacatctgtaacagacgtcaagtttggtcccaaatctcagggactgcaactagctacttgctcagcagagggaatcatccggatatacgaagcacccgacatcatgaacttgagccagtggacgctgcagcacgaagtgcagtgtaagcttccttgcagttgcctgtcttggaatccaagcctgtcaaaagttcatcctcaaatgatagccgttggcagtgacgactccaacaccgccaacgggggaaaagtgttcatatttgagtacaatgagaacagcagaaggtggactaaactagaaacgctcagcactattacagacccagtacacgatatcgcattttcaccaaacttgggaaggagttatcatattctggctgtagcaagcaaagatgtcaagattgttaatctaacaccactcgaagacgaacaaactgcacaaagtggagttaccaaattggatgtagaaacaatagctcagtttgatgatcacaacagtttagtatggcgagtgtgttggaatttaacgggcactattttgtcttccagcggagatgatggttgcgtcaggatgttcaaaatgaactacataaactcctggaaacctgtagccgttctcaggggcgacagcacgcatgctacagtcgaccaaaaagtctccagcacctcaaacaacggaatgaatggcaaccctgcttcccaaacggccagatacatcaagttaggctccatttcgtcccaaacaagagacgtgatatggcactaacgggaataacttaataacttgaaaatcttgctgaagagtatcatcaaagtgtttacgtgacttattttgttattatcgtgacaagttacaaggtgattcaaaaacagctggcagagtggggtaactaacttgtgacaataaaagtaattatgtactgtacgtggtttcattttgataatggatctcttagtcaatatacgagttact

SEQ ID NO: 583 - DNA, 1467 bp, Leptinotarsa decemlineata
  Annotation=Rnu3ip2 protein (Fragment); Tribolium gene name from OrthoDB database=TC014174; Blast E-value Tribolium Gene vs. Leptinotarsa Unigene=5E-131
gacgtgcatagtccgtatttggaagttgggttccaatttttatgattttagttcttaatctgaagaatgtcgttctttattaaaggcaagcaagtgaatggcgtgaaacgtactaagtacgctaccgacaaaaataataaaaaacgtaagcttaacacaaaagccaagaattccaagaaaaatgaagaaattaccagtagtgaagatgaaggtttggatgctgacaaaacagccgacacttattcatccgaagacgaaaatgaaactgcacaagaaaagaaagtacgactagcgaagctttatttggaagaaattgaaagagaggaacggaatagacttgaagacaaatacgtggatgatactgttatctcgaggagacttaaagaagattatttgaaagaaacagggcgacttaggctgacggttgcagagaaatacaaaagtgtagatgaagaacagattaaaatattgaaatcacgagagcaaagaaacaccataacttgtttgtgcctttcttcagatgataaatacgtgtttgctggaagtaaagacggagcagttgtcaaatactctttaacaagttataaaaaaagaaggcattataccatttgttaaaaatcctacttcagaaaaacccctcggacatagtagtcagattttaagtatagccatttcatcggacaacaaatttttagctgtaggtacgaaatctaaggaagtgtttgtgtgggatccaaattctctcaaattcatagagaaattattgggtcataagagtgctataacaggactttgcttcaaaagagactccaatacattgtattccagctctgaggatcgtactctgtatatctggaatctagacgagatgacatatatagacactttgcttggacatgaatatatcattacttccattgatactctctataaggatagactggtttctagtgggggacgagaccttcgaatgtggaagattcccgaagagacgcagttgatattcaacggccatttgggaaacatagacaatgtcaggcttgtaaatgaagaaaattttgtttcgagtagcgatgatggacaactgtgcgtatggagtatgctgaggaaaaaacctttatgtgtagtggaaaatgctcatggcatagaccccagtaatcatcagccatactgggtaagtgctctaggagcacttgtcaacacagacttgttggcttcagggtcccaagatggctctgtaaagttgtggaaactggaaaacaattttaaaacgtgtaaattgataatggaaataccagtggaaggatttgttaactgtttgagtttttcgtctgatggtagttttctaataatcgctgctggtagggagcacaagttagggaggtggacaacagtaaatcagcaaagaatcgaattatagtagttacctttttaaagcttagaattgtttttcacacctgtacattg

SEQ ID NO: 584 - DNA, 949 bp, Leptinotarsa decemlineata
  Annotation=Putative uncharacterized protein; Tribolium gene name from OrthoDB database=TC012878; Blast E-value Tribolium Gene vs. Leptinotarsa Unigene=1E-52
gtcacacactcagcagcagttctgaaggaggttcgccaaatgtcacagcctgcattgcggaagatcgtacagtgttaccttctctaccagacctttttgatgaacttgatgcagatgtcgacctcaactcgttggaacaacttacccagagtttattacaagatatcgccagagacctgcaagcaagttctcagaaaacagataatcaggaaccacaaaatactgaacccagtgcatgtcaagtggtggggaaggcaccaaaagaattggaacccagtagatgtgaaattttaagcgagaagaaatcgttggaaaatgatatctcggaatatcttctgcttcaccacaactatgctgcaaaacccccaaaaagcacaagaaaatccaaattaactagcacaaaaaataaattgaaacctattcggcccaaaaacattttggatacaagtaaatcattggttgaaaggctcgctccaaagttaatagtgaatgcagacatacctgtggtaattagtgaaaacgaagatgtcttatatggaactctggatgatgacacaaacaccgttacaatttacgttgatgacgatagtatacacactgctgaaactttagccgaggttgtagctatggaaagtgaagaaatttcagaagaaaatgcacccatcgtttcaccacagctcaagcaatgtgcttctccattttcatgtagcgggtcagatagaggatatgaatctttagattctccctgtagtattcaagatgatatttgggatcaaagtatttccgagttgtttcccactttattttaagtgggacactgtaaaatgtatatataagataccaaaaatgattctctacttataatttatttcaatattctatttaagtatatttttattttcaaattttatgtaaatatatcttgcaaataaagttgtggttgtaaaac

SEQ ID NO: 585 - DNA, 2029 bp, Leptinotarsa decemlineata
  Annotation=CG6038; Tribolium gene name from OrthoDB database= TC000323; Blast E-value Tribolium Gene vs. Leptinotarsa Unigene= 1E-8; Blast E-value Tribolium Gene vs. Leptinotarsa Unigene=0
agatttgatattttattcatttttgtaaaaatatatatttacactgtataaaacttactattactgtaaaattattcttaaaaattatatggacaagttgaaattttaaaatttgtggaatacataaagcgtcaaacataacaaaaactacatctacagcttcattttttatcttgattaataatataatgaaaaaactagagactagttttaatagtctctactgagaaaaatatcactagaagatatgcgacaaaataatggacggaatgtattttaaatctttgccaaaagacagtttgatatcaattatatcctaattacttaaacataatacacctttcattcaaattgaataaaattcaaactatataaatttaatctcgggccttctttactgcaaataatacataaatattaaaaatgatttgttgaaacctttggaggagacaaaataatttgcagtaaagagaggtcatggatatcatttttcattcagatgagattcaataatttgtcaaaactttttgaaataacaaacaggtctgtgtcggcattaaagtgttgccccattgatttaaaaaaagttcaatttttgcagttacagttgcctatagtctgttcaccaaacagatggagcacatggtggtgctaaaatttttgtgtatattctaatttgctggtgaaattgctctgcatcatcagttttaatggtttttttgttaatcttgaagctaactttgtaccacaaaatgcacgttatcactccatctgttcggcatgcgaactataataatagttacagaaatatatgtttctctgtactagaaaaattgataatgaggcttttttggactcattattaaacagttatgactaaacttctaaaataaaaataataattataaaagaagttagagtagtaaaaaatccaacctgtcggtttgatgccagtataagacaactttggtacgcagaactagctttagctgaatattacgactatgggtttaaatgacaaatcacactaccgatagtagttaagactaatttatagaatgagtgggtgaaaataaactgtcaggctatggaccacgtttacacggtatcttggaaaactcataactgatattactaaaaccaatctggagttgaaagtttgaattatgtaattctaggttgaaaatcaaaaattccgagttcgacgtttccaagttagaagtaataaaaataatatctagtgcatgaccaaaaaaatgaatactctcctggcaagtttcgcacaattagtgttgattactcaatctataaattaggctgtggtaatgggtaccaacaattttcacatcagtaacacattgcaaatgcttgccagtcattcgtatatggaagagaattgttcagatcattcacaagggctaacataccctacaattgctgatatatagcaattgcaaatcctaaacttattactgcagcagaagctttgcttgaaaagcctccattacacctgtggtccaagaaacaaaaacaccatgtcgttttgtcatagtaatttctataaatgtccagttctttgttactattgttgacataatttgctaacttcagatctattgctgctgggcggcatccttcatagtgatcagcaggaatgtcagtgcgaagcccctgcatggagctcaggcagtctctagttataacggaagaaccatctttttcttcgattattttaacacagacatcatcatcctctgggcatatttttgtccagtgaaaaagccaattaaatggggtaccgcaacctggttgtgttgacacacattggtagcaccaaagggcattgctttccactgtaaacagagtcaaaatagataatgctataacgtaactggtaaccattattattagtattaaattctagaaatttacgaaccaactctatacctaattattaactagatataaaaaaatgctttttgaggttttgttttgatcgattccactctgtttatcgtttcgtaggtat

SEQ ID NO: 586 - DNA, 1559 bp, Leptinotarsa decemlineata
  Annotation=Endonuclease G; Tribolium gene name from OrthoDB database=TC004390; Blast E-value Tribolium Gene vs. Leptinotarsa Unigene=2E-1; Blast E-value Tribolium Gene vs. Leptinotarsa Unigene=09
acttgtcagtttatccagcaaatggcgttatgacatatgagctgagttcaagtttattagaataattttgatttcaaacattaacatacaattgtagttttcgttctgataaatatggactccaaaactgggcatagtgaagatgaaagtacccatacaaaaacatccaaacaaagtaacatcttgccactttggggcaatgaaagaaccatgaatttgaatcctttgatattgacaaatatccagagttctcattattttaaggtgaacctttatgaactgaaaacttaccatgaagtaatagatgaaatttattacaaagtcagtcacttggaaccttgggaaaaaggttcgagacgaacatccggacagacaggaatgtgtggtggtgttagaggagtaggggctggtggaattgtctcgactgcttattgccttttgtataaacttttcacgttgaagctcaccaggaaacagctgaatggtctcatcagtcattgcgactctccatttatccgtgccctaggtttcatgtacatacggtacacttttcctcccgccaatttactagaatggtatgaagactatttggaggacgaagaggaattagacgtcaaagctggcggaggccagacgatgacaataggattgatgttgagacagtggttggttaagctcgagtggttttctacacttttccccaggatacctgttccaattcaacagaaaattcaaaaacatttagagagtcgctttccccctcatgcagttcaggctgcatcagaacgggcaagacaagacagaagcaactacgatcgagacaacagagggacctcaaacaacagagacagagaccaaagaccgcctcgagatgacctaagacgagattttctcagagacgataacagacgactagacagagatcctagattcgataggagggatagaggtggagatttcgaaaggcgagacagagacaggaagctgaaggaccgcagccctgtcagacagagaagtccaccaagacacaagagctacagtagggatagaagcccccacaggtcacacagacacagggatgatgagggaaggggcaggagacattattgagacctggaaggttttgcatgttggtcaaatccttgattttgttatgttgtgaagtgtcttttcacttcatttagaaagaacttgagaatatttagagaattgtaaagcaattcttttttgtaatacttgataaagggttttgacaaggttttgtcaatagaattaaggtttttttttattcaagacagaggagccctccgaataatcatattattgtacagctgtaatttcaatacaattttcagagataattcaatcaaattttgtgtttataagtaatattacctcatagcttaagagcttgtaaataatatttaaaccaaaagttggagataggataattcatttagtttattaaattgatttttttgtatctcggtaaaattaaagttgaagaaaaaaaaaaaaaaaaaaaaacgtaactactagacgttagaattaaccaactg

SEQ ID NO: 587 - DNA, 2333 bp, Leptinotarsa decemlineata
  Annotation=DNA replication licensing factor mcm5; Tribolium gene name from OrthoDB database=TC009146; Blast E-value Tribolium Gene vs. Leptinotarsa Unigene=0
gtttaatagtttatcatttatcattttcgaagatttgcaatacagcaatggaaggatttgatgatccagggatattttttagtgataacttttctgtggatgaaaatcaaagtgatgtacaggttaatttaatagcagtaaaaaagaaattcaaagagtttctccgacagtatcatactgataatttcaactacaaatatagagacaccttgaggagaaattacaacctgggtcaatatttcctagacgtcaatattgaagatgtgggaagctttgacgaaaacttggcagataaattgtataagcaaccttctgaacatttaccaatatttgaagaagcagcaaaagaggttgctgatgaactcacttcccctagaccagaaggagaagagcaagttgaagatattcagttaaatttatcatcagatgcacttccatcagatttgagaactttgaagtctgacgttgtttctcgtctggtaaaaattccaggaattgttgttagtgcctcaggtattagggcaaaggctactaaaatctcaatacagtgtcgcgcttgcagtaatgtcattccaaatctacctgttaaacctgggttagaaggttacattttaccaagaaaatgcaatacggaccaagcaggtagacctcagtgcccacaagatccttatttcattatgcctgataaatgtcattgtgttgactttcaagtgttgaaactacaagaacttcctgacggtattccccagggtgaaattccaagacatattactctatattgtgatagatacttatgcgaaagagttgttcctggtaatagagtgtttgtgctaggaatcttttcaataaaaaaaattactaaatcaaccaggaatgaaggaagagaaaaggccataacaggtgtccgagcagcctatatgcgagttgtaggcattactcttgacactgaagctttgggagctttaggttgttcaattgtttcctcagaggaagaaagtactttcagaagattagctgcttcaccaaatgtgtaccagaaaattgctaatagcatagctccttcaatttatggttctattgatataaaaaaggcaatagcctgtctactttttggtggctcacgcaagaggcttcctgatggtttaacacgaagaggtgacattaacttactgctcttaggagatcctggtactgcaaagtcacagctgttgaagtttgttgagagagtagcccctattgctgtttatacttcagggaaaggtagttctgctgctggtttaactgcctcagttataagagatccatcatcgcgtaactttgtaatggaaggtggtgctatggtactggcagatggaggtgttgtttgtatagatgaatttgacaaaatgagggaagatgacagggtggccattcatgaagctatggaacaacaaactatttctattgccaaagctggtatcacaacaactttgaattctaggtgttctgttcttgctgctgctaacagtatttttggaaggtgggatgaaactaagggagaagaaaatattgatttcttgcctactatattatctcgttttgatatgattttcattgttaaagatgaacatgacgaacaaagagataggatacttgccaaacacatcatgggagttcatatgtccggtcaagctactcaagaacctaaggaaggtgaactgtctctggaattcataaaaaaattcatccattattgtcgaacgcgctgtggacctagactgaatgaagaggctgctgaaaaattgaaaagacgctatgttatgatgagatctggagccttccagcacgagatgaagtctgataagaaaagctctattcctatcacagttcgtcaattggaagctataattcgtatatctgagagtttagccaaaatgcagttgcagccgttcgcaacagaaacgcatgttgatgaagctttgaggctctttcaagtgtcaactttggacgcagctatgagcggaagtcttgcaggtgctgaaggtttcacaacagaagaggatcatgagatgctgacacgtattgaaaagcagttgaaacgaagattcgctattggtatgcaggtttctcagcagactataattcaagatttcactcatcaacaatatcctgaaagagctgtcttgaaggtaattcaagctatgatcagacgaggtcagttacaacatagaatgcagagaaaaatgctttatcgcattagttaaaatgatccatttgtaagtgaaattatattttattttgtttacaatcattaatttgttgtacttcaataaaaatagataattttgttactt

SEQ ID NO: 588 - DNA, 2581 bp, Leptinotarsa decemlineata
  Annotation=Ubiquitin-like protein 3 (Fragment); Tribolium gene name from OrthoDB database=TC008091; Blast E-value Tribolium Gene vs. Leptinotarsa Unigene=4E-63
gtctgctctgcattgttatattttgccattacctgttctggtcaagtgtgcaccttgtgttttcagtgcagtgtttgatccattgttcatgttaatcgtgcagttactgttgatgtaaatacggagaaatagataatgtatagctaatattcctggtttcttcagtgttggtgaagtaaagtgtaactttctgtcatggagtttgtgttgtgacattatccgatttcagctccagccacttgataatcccaggattttggattatttgactgcaacgacatgtctagcaggcacatacccgcagataagataaatcttcgtctgatactcgtcagtggcaaaacaaaagagttcctgtttagtccgagtgattctgcaggagacattgcacaacatgttttcgacaattggccagacgattggtgccaagaggcggtttcaaaggctgaaatactcagactcatttatcagggtcgttttctacatagtaatgtaactttaggtgctttaggattgccatttgggaagactactgttatgcatttggttcctagggaaaccctgcctgaacctaattctcaagatcaacgacagaaaagtaaaggaggaaacagtagttgctgttcggcatcctgttgcattttgtaaactgtacgtcattcttttatacaggaaaactataaaaatagatgagtattgtatatgggacgagaataacgaagaatgggtctcgaaactatgtgtaattttaaagttttaatttcaactcgatgcggttagtaactgtaaccaaaaagttttaagtaaagttgtgatatatgtgtataaaaaatgatactcaatgtgccagacttttgagtgtgtgatcaaaggaacttcacattcatattgttatattttttgtgtaattaattatatataattgtatattgtgttatatcgtagaaaaattgtaatattttattgttttactcattattcattcttgcaattgtacattatttcatccttaaactaagaagccatctatactttggtaacaatcgtaatatttaatgaaaatattacctacttaacgtaacctgaaagataaacataattgtgctagtattacatgaagtactattcgatagaagaatgatatttcaaatttcatcctttactttttcaaataactcctggtaatgtcatctcagctttaaacattttataaataatcataactgatctcatataagtgatattttttatatgtgattattttcaactcaagaagatccattatttttgagtttttcaaagtgggttttgctttgcaaagttatttctacatttcatattctatcgaatggtagatatgtaatttttacatctaaattgcgatacttatactacattgtttggattaattatcaaattttgttggtgcaagtaatcctgctcttattcttatttcaaacaccaagtaaggaattgaacatgttcattatcgaaaacatgaatattaccagtgaaatgaattatgtgtaaatttagttttgatatttcaataattcaaggaaaaaactatttatctttctttcgcaatgaagaatgaaaccttgaagttttgaaaatttcacaatttatggtgtagagtcaagtgatcagaacctaaccaaatatgatttgttgtttgcagggattttccaaacactaataaaacactaataaaacactataaatatacaaagctatttaaatagctaaattaaagttatctaacttttaattcattgctttattaaggtattctgtcatttcaacaagattctggttgctgactaatatattttaaattgaaaacctattgatttttatgactacttgtaacatcatttttccacaaactgtttgttttcaattttttatattttcattcgtctattgtataaagacttgtttgtagaatagaaaatggatctagacaggtatattctaagctgaacttgagtaatcttatttcttaggcttgatctgttgtatcgaagtattaggatgaagtctaaagaaattagttttaaaaattatcagattggtttgatcaaatgaatgtttatattacataatatttaaaaagaacaaaaattgtattacttaagtagatatatttgagttacctcttgtaacaactataacagagtatatttgaaaaattttaatagtttaggtcatgtcgacatccatctctcatccctccatcttattttcatttatttattacaacacatcaacaccaattccttccaaattttagcaaaaacaacgagaggtgtccaattttctgtgtgttttcaaggcaatacaaaatttacaaacatttgaaaattgatttccttaatactgtgacttatagtaacttcaatggaaataataggaagttagatcctatgactataagagtggtgttttcaataactaacaccatattagcgaagatgcatgtatttttttattctttcaaataattgatgtggtcctcaaaaatctcgaacagtacaactattttttttcattgaatgtaattgagtagtatatcttc

SEQ ID NO: 589 - DNA, 2346 bp, Leptinotarsa decemlineata
  Annotation=TBC1 domain family member; Tribolium gene name from OrthoDB database=TC015747; Blast E-value Tribolium Gene vs. Leptinotarsa Unigene=0
tgataaaaccattccaatggccatcatataaaatcctatactttttcttcacttactgaactcaggatattttcatttcgagaatagaatttaaaatactagtctagtcaacaaactcttcgaggaagcataaggtatcatcgacacgaaagtaatcttactattctaaaagtaatatcacactatgtgtaaaaccaactcaaatatcacttgctgacaacgtcagggttatagtttctggaatttttcatattcttcatagtcttaagttccctagtacccgtataagtaaaaggaacgccacagttactcaaagggtggttatctagaggtatgggactcacaggtgtaacaaccccactatcatcagatttggtggatacttcactattttcgaattccatttcttcgttgaatgatctttggttaacagtggtattagaattcaattcattctcgaattgttggattgtgatatctattctggcgttattcaaattgctattctgaacgttcaatttttgttgcaatatattgttgtggctattggagaaaaattttgaggttttttccgtcgaactgggaggggatgttttcatcccattcagaacattgtcaccgaactcactttgattgacgttggacggtacgttcattttcccagtactctgagatttaacaaaaattttatctgaaggtttctggaacgtcctcatcaaattgttttgttggggtcgaccttcgttctggcgtctctcactgaaggataactgagtcagtatccgttgaatgtcatcagggatttctacatcaactttttgttccatcagtgaatttatgaaggctccaagggtcgctatggtaacattcagacctctactttgcatctctaacctattgagctgggactgttgtaatgctctggttttttccaggcgatgaacattggctacggtagattctaactgacgcataagaagttgattctgatcactcaacaatttgttttgggattcaagtttatgcagggcttccacctgtggttgtacggaggtcatttcttcttgtagaacctggtactcgactttgtattcgttcagttgtttgacgcagtccgtcgtgaaaacctgtttcatcagaatatccaaagtcgacctatcaatctttggcaattgtactttgaggtagttcatgatttcttcgaaactatcgcagacgagtaacttctctttgtgatgagaaagaagagccagtgataccctgaatatgacttctggcccctccaagaacatcagatcaaaaactctagtaacgaatcccagaggaaactgggaagcaaacacggtaagtaaccaaggagcggcatacaatgttggagcgacttcatatgtatcaaaaagggtgtacagttctggaaggtgatctcgcactagcctagagagttggtagagtttgatttgaaggctaaccatgtctggtagatactgatttcgcattccccttctgaacatcagatacttcagcagcaaaaaggcctgagattcttccatatgtaacagcaaaacacccgctacaaaactcaagccttggcaatatcctacttcgggatctagcaatgagtatgctttcaggacattgaataatgctagttgaccaggtcctagtggactactgaagtatgagtgattgggaaaagtacggccaagatcgattaaaatagcatgttgatgtgaggttagctgtttgagcaaagtctcataaggtactgcataattcggatagttgattgtatcaatgggtggtactctagaacagaattgatctgccaaaaattgccagacgtcacctcttttgctacgtggaactccctgtcgaattgcatggagtaacatttgattgtcgcactttattctattgctatctttagtagtgatcatttcccacacctctataacctccctttgattcggtttcatctcatcatattctaattttattcgtttaactgcagattcttcttgtttagctcgtattctagcgttttccttttccatcctgatgagtaaaattgcttggtgaatggacttcttccagagtactctcaattcttctttagtcctttgtttcccgggttgttctattctatcaagtttattgggcgttacaactcttttgaatattgcttgtctccaagatcccgaatccaccttattcggacacccgtcttctgatattgtattctttggactatttccaactttcatgaagatgtccatcataggagattttggcgccttctcagaaccgaaaactcgttcaggagagtaagaatctttatgattatta

SEQ ID NO: 590 - DNA, 2486 bp, Leptinotarsa decemlineata
  Annotation=CG6672; Tribolium gene name from OrthoDB database= TC015914; Blast E-value Tribolium Gene vs. Leptinotarsa Unigene= 1E-13; Blast E-value Tribolium Gene vs. Leptinotarsa Unigene=0
taaaaattgtttaattaccatggatagtgtcattcattttcatcaagtaacgggccagtccattcatttatatttattgtttttttatcgatttgaaatgctttttaaacattgtataaagaacttgattcatataaaaaataatacaatttcaaaataataaaaaacagttggatgaaagctagttgagaaaccacaattacttaaaacaagtaagtatatatatattgtttttttatcaatttgaaatgcatttttaacattgtacaacgaacttagttcatataaaaaataatacaatttcaaaataaaaaacaaatggatgaaagctagatatgattaaaataaaaaatacactcaaattctacatttcacatatttacatacaaattccctcgaatcttgacctgttatttccacatcaagtagaaaacataagtcaaaagtatttattataaaatatatattcaaacaaaaattcaacacaatcacgacttaggaaattgtcaatataataatgaacttgaaggtaattttagcatgaatttttacttttttcaatattttgcacttatttgatcaaggtttatgtattagtctgtcgatgtgtttagattcacctaaatgtttggtgttctccagttgttgaaaggataaaatatttgaaatactaaactaactataatgtagaaaaaaagtttagaattgaattgtcaatgtctgagtattacactattttaggtgtgttacttattggctattattttcatcattattgtgatgaggatgaattaattatagcagttgtctgtttctctatctgaagtttgtgttgaaaccttgtcttagctgctgcaaagattcctctattcaaaaatcaaaaattgttcaagtaaaaaaatttttttttagttaaaaaaagaaaattcataaaaatgtccccttcaactaaacaatgttttgttataccttacacagtttttgattgggtgtgacgaattggtttcataaaataatattatcgagtaatatttcagttctgataattcactggaaattgttttagttcatgaacatcatagtggattggtgacatttcttaaaaactgttcaaaccgatcctttttatcacattggggtataatctaattgcacgtaaagttgtctaacaccaactgatgcaaaaatcatctgggtatgcgacactacatacttaggatcaacagtcttggacacttctaattttaaagcacctacataaaagtcactacaaagtgtccagaaatgtggttcttggacagagtacactcctgctaaactaaccactttttgatagcactgcggtaaagcattatcaagggctgtaggctgtctctgcattaggatcaaaatagaatcttttattagggctagtacgctaagagctataagaatagaaatgaacatagaacaaataggatcggcaatcatccaaccaaacatctgcataagaacagctgaaattataactccgacacttccaagagtatcagccagaatatgtaaaaatactcctttcatgatctgcgaatttcctgcgtccaattctatgtcatgagagtgatgatggttatttgatgtatgagaatggccatgggaaggaccgccatgagagtgcccatgagaacttccaccgtgtccatgcccatgctggaaggcatatattccaactaaatttactaacaatcccaacactgatacaataaaaagcctttcatgttttacctcaggtggttcaattgctctttcaaccgcttcggacatcaagaagaaagatatgaagagcagaaagagtccattaacaaatcctgccaatatctcagctctaacatagccatatgaatatttatcattagctttccacttcgtaatcacagaagctaccagacctgctaggagaccagtacaatcgaagaacatatggaaggaatcggatattaaacctaaactgttgctccatactccataaactaattctacaaatgcaaaggagaggttaagaagtagaaataaaaataaatttcttgaatttctgtctgaaaatatgagtcttatccatccttgaactttttccttcattcttgaaccaattcctctggaataggattggtaggcatctttatgggacaacggcaacatattgtcaatacgtgtttttcaatttataaatattgatattttttcaaaacattactaattaaaataaaaaatatgattacgtgtccatttcaatgactagaaaaacttgtaattgttcacaacaaataatacaaataatcaatgcggtaattttaatgaaaatactcattcacgaattaatttaaaaatgcaaaaagactgctacagccgagccggctggtgaaaaaaaatttagcctattcaaataggctatcctaaatctaaataaaccataagaccgaaccacagttttccgtagctatacagtc

SEQ ID NO: 591 - DNA, 1383 bp, Leptinotarsa decemlineata
  Annotation=Pollux protein; Tribolium gene name from OrthoDB database=TC015747; Blast E-value Tribolium Gene vs. Leptinotarsa Unigene=2E-169
gtaaccgatttgtacaaacagatgaaagaacaaaaccacgcagccccgactaaatcaattagcagtgctggtaatctaacttctctttgcgttgatatatcacctagttcaagtaatttttttgaggttctctatataggtaaaataaaagtgtggcaacgaaaagtaccagacaatttcatagatgaagctttggaaaaatttcgaatacatgaacttgagaaacatggatttagacaattgggaaacattggaaaattgaagagtgaaagtgaactttttcgaagaggatcagtggattcttcaaatggtgaatctagctgcgaaaaaaatctcagttcacccgcaaccccgcctttgcttcgatcccaatctgtccattcaaatttgataaaacaacccagtgatacgaaaaatgagtcggacatacctgaattgaagaatgacggaggaatacctatcactcctataacgaaaagttgtaatgatgactctgctaacaacaacaataatccttcacaagaagtcaagactcatagagaaatggatgatcacaaccgtacgatggtattgcaggtggatagaactgatctgaggctgataagtccggatagaaaaattattttgttgcataagcaccaccgggatatcaccacatgtctacagggtcaactgaaacctgaacactttggatttatatgcaaggagggctcaaacaataattactttatgggttatattttcaaatgcgaatcatcttcagtggcaaatgatacaatggcagctatcactcaagcgttcctcaatgcggaaacaaaaacaacttgttccactgttacatcctgcgagcactgtccaatggtctggtttcataaactctgcgttgaggttgagactatgtccgataggaaaacacaggccgccattttgagaaggatagaacaacttgatgatgatgaacaaacaacgattctgacgaaattcagaggagctgaaacagattctgtgagagaacaaaacgagttcctcatgatgttgctcagagcacactgtgaaatgaaacaaggaaggcacgttcacgacactgccgaaaaccggtctgaattcctgaatcaatatctaggaggaggcaccattttcaccaaagcgaagagatctttgagcaactcctttgaacactttttgaaaaggaaaggatccagagatgactttggtggttcattgaaaggcctgaatcttccaataaatagtaacttcaacaaagactgcctctctcattctccatccccgagcacgaacaatgatacctctgatcgagaatcagaaggtaccagatccagatcctccacaattggttcacaaaatgacctcagagatacacac

SEQ ID NO: 592 - DNA, 6173 bp, Leptinotarsa decemlineata
  Annotation=Leucine-rich repeats and immunoglobulin-like domains protein 3; Tribolium gene name from OrthoDB database=TC001607; Blast E-value Tribolium Gene vs. Leptinotarsa Unigene=0
gattctagtgtccagtgatgcgttgattgggagagtatgttttgtttgagtgttttgacaaatatttcttctcgtcagaggagaaaatgttgctaacagattgaatttagtgatataagacaaataatctgcagacagtgtacaagtgccccgaatactgactttctgtcataattttgagcaaattatgatgggtagtattgttgtttttttcaaatggtggtgtttgttttggtttaacataatattcttgataagtttatgtttggcgaaaccaaaagattgtcccaaagactgccgatgtttgggtacctacgttgattgtgttgccaacaagtttgagaccattccttccaatatcccaaaatgggcaacgcacttggacttgcagaataattccatcaagaagctaactgacataaactggaaacctctgtctgagttgaaggaactgattttaaataaaaatcacattgctgtcattccagtggaggcattgcaataccagactaaacttaaaattttagagttgaatcgaaataaaattaaaactatagaagctttgaattttaagtatctggagcatttgagcactctaaaattgaaaagaaatcaaatatcagaactcaaggatggtgctttctatggattgatggaaatagacaagttaatattggactacaacctactaaaggtaatttcaaagagttggttgtatggattagaggcgctgaaggagctatccgtgagtcacaattatatcaataaaattgatcaagactcttgggaatcttgtcacaaacttctaatcctagatctttccttcaacaatttggaatctatcgaagcagatacattcaatggtctggagaatttacaaaaactctctttgcataataacagcataacattcataagggaaaatgccttcgtccatttaccaaaactgaaatttctgaatttgagttacaataaaatttggttgacaattgaagatgctacaggtgtctttcaagggctccacgacttgatgaaattccatttggccggaaacgggatcaaatctataaatgctgaggcatttgctggactaaaaaatgtgacatatctcaatctgagtaataataacataacctccattcagaagaatgcattcagccacattccacttttgaaggaactaatgataaataccactagtctactgtgtgactgtaatttgaggtggtttttgaactggctaaatttgaagcagttgaaagtacaggcagtatgtgcctaccccgaatggctccaaggggaatcgcttctagaagtaactagtaatttgacgtgtgatgagttgcccaaaccacgactgatagaagagcctgaccatgcaataatggctttgaaaggtgaaaatatatccttggactgcaaagctatgtcaagctctcctgacccgatgacatttttatggaaaaaagacaatatcgagttgaatgaaccgaatgtaactatcgagtctagagtggatccggatgggaaatcgactgagacaagttcctgtctccatctcacaaatgtggaatactcccacgctgggaagtaccagtgtgtggtttccaatagtttcggtaccacctactctcagaagtcagctatatcagtattggtatatccaactttcaccaaagtccctaagaatgtgaccgtgcctgcaggagaaacggtcaaatgggaatgtgcagcaaatggggaaccacctcctgaaattgcttggcacaaaggaggcggtaatgattttcctgctgccagagaaaggcggatgcaagttatgccccatgacgatgtttttttcatcctcaatgcaaaacctattgacatggggatctacagttgcacagcccacaacgctgctggtactattgttgcgaatgcctcactgactattgaggagaaaccgtccattctgaagaaaatggtggataaggaattctctgcaggtgagcacgttgtgctgcagtgcctggctaaggggattcctaaacctaccataacgtggtggaaggatggcgaatctatcataccgaccgagcggcattttttcatccatgaagatcagatggttatcatagtggattcagtacaaacagactcagggatttatgagtgccgactgaacaattcccttggagaagtaagcgacaagagcaggattgtagttaaaccaaatacctatgacacgagcaacatgttgggaataatcatcatatccgttgtgtgttgtgccgttttgacatctatcatttgggtggtgattatctatcaaactcgtcggaagatggcgacaccagtcgttcagacggaattgcagccaattccagaaactaccgacggaagtcgcacccttcaaatgcaacatcagctctatggggacaatatatcagaccagtcgtcttgcaaggatagtgggaccggagattctgctaaacgtagcagtgacgacctagaaccggattcgtttgttgctgctccggatgcgggtgaagcggatgctcttaatttacactctcctttgctgcactatccgaccaaccatgataggattgtctgttctgaaagcgtttctattcatggggtacccttggaagatgtttagccgtgggtgaggaaatatatcaaagttgattgatatcaaagcgaagattcaacaaacaacattataatattgaaggtaatgtatattatattatctctatttattttacttatgtgtagtaagccatattaacacaaattgttcaactaaagtattattatatgtgtattctacttacaaaatggaaatttaatatactgattgttacttaaaaataatgaaagcacagtggaataatggaataagtattttcctattagtatattaaatatcctcattaattttattgaaaatagtactacagtttttcactatttgactgatcaaaactgaaactaataatgagtataaaggaccaaatcctttcataataaaatcaaagacaaattgccattgaaaatggcaaaaacttttctgtgttttttcttcattatagtgaaactactattcttatattattctgaaaactttccactttgaaaaatctctaaactatttagaatttcaatggtttttagtagtggtaatacaaaaaaaaatcagatatgtaaattttgtatataagagtctttatttctttttaaacgctttgaaaaatttacaaaaatatattttaaatttgatatgatggccttgaactttttgaacgaaaccttgaacctgagaaagattgccttattgcctactttacactttccgatgattctgcttttcacttacgtattttctaacagcaaatgcaatatctgtgttaattgtcaaaattgcatcaattgttttcaaaaacaaacattattttgatcagcaaatgcaatatctgtgttaattatcaaaattgcatcaattgttttcaaaaacaaacattattttgatcaagcttcgaatggcgatgaagtttccgaaatgttgtcgaagtcctgtcgagttgtgagtgaaaatcagagtctggaagtgaatcgatggtacaggagtaagtgcggtcaagtaatatgtttatgaatgcttgactgtacaccattactatgcctttccaaatccgtcaaatacttgaagtgtccttgattgagtgaatttttagtaacacaaattagtttctttcaaatagttcctatcaaacactgcagttgcgaatatgctagtcttcaactgttaatgaaataaacatatatatagaaatatcactccaaaaagtttttagtgtcggaaacattgtctgaaattatcaacttttattcaaatttgtcacagatttcgtctaataaaaaatagtttgttttcagcggtttttttaatacttctcttttcaatgtgttacttttgcagagataatacagagtggttgaaatatacctattcatatcctcatgaaatgttttggaaaggatgatttaattttcacatagaaaacttaacacattatctcagattatgttttaagataatccatataataaagaagtcatttgaaaatatagtcaacattccaggaacatagtatattttgctttttgtgtttgttgactgtcgttcattttagtggatttctcaacgtttcactcactctagcggttggtatcttcaggagtacaaaaatcaatttttcctctctctaaatcacagaaatctttgggaaatagaccatagtttctttaattgtaatatgaaccaatgaaagtggtattttcagagatacagttatgattacaaagcagttaatagaactccgtttcacttctaaaaatattttcaaatgatttataaacaagtttttggtaaatgtctcgtctttacagttttttggaataatctttatttgtatcttataaataaatctgtttcagtttgttagctaatgtttgcaactgcagaatttcagttttaaatcgacctgtcaaatgaaacggtgaattagatagatctctttttttctgtaattgaatgtgatatttgaccccgaaatgaaaattgaaagtgtatcttattttgacacaaaagtgcctaatcgaatttgaccgttgattttgaactgttcgcatctcaactaatataatttttctcagttcctgatcttcctaagttagtctactgttttcaagggcaactgtatgttttactaataccttgtgatattattttaaaaaggtatttttttacaaattttatttgtacaaaacctagattttatgctgccttactgtacactgaaatgagttgaaatttttaatatctgttcgacattactttgtctcatttgacaacctatttcactttttcagagaatgtatacatttatcagaagttcatacttcaaactctgttgtttgagtcaggaaatgtataactcattcaaaaatatacaataaaatctctaattgaaatcatgtagcaatacattgattaacgtgtcttcatgatggccagtttgtttcgccatcgatttgagaaataatgaaatgaaagtcagaattaaaggccaccactaactagtcttttgatatttattttgtaattttttttcaaatatattaaaattgttttatcaaattttccaatactccttacaaaaggtagagcagttgtaatttaccaagaaatattaaggtctttgaaatattacagtgaaaatagttttcagacaatcagcttttcaattcaaatgaagaaacatttttatttgtaaaaaacaatgtgaatcaatgaaaatttgctttcacggtataattttttactattaatctatcctttttttttagaattgataaaattggtttaaatttttgagttatatattttctgcgaatcagtgtatgaaatttaattgaattctgactcggaattgtttgccagtagtcctggatatgatgtgtctatattcttttggagtctgtggtccgatccctttcatagaaggggaaacggtggatattgccttaactgtgaagggcattttcaagctatgtggtactctcgacgcgcgatgtaagacagtcgtcttacggttttcgagactactacgttactagtgaagatgctcagttgcaagcaaaacggtcacactgcagtgtaaagaatgctctttctctccaattgcaataaatataatcttattttggccaaattttcttgacagttttgttgaaatttcaaagttttagtgaaataatgtcatttgagccaaagtgatacttttaaaaatctattattagttatttgtaaacgtagattattctatttttggctgcagtgtaaatagctcgcatgtgtacaacttagttttaacattatttactgtgggtgtgtttgctacaattatttattgaatttgtatgtacctgtgcgttaatgtgttaattgttttatcgtatttcgactcacaatattaatggttatgttacacaaaaattattctatttattctaattggtagaatttaaaagtatttttaaattgtactgtcactattatagtattactaagtatacctcattattactaaattttttgttcgaaaattaaattgtgtagttcg

SEQ ID NO: 593 - DNA, 1307 bp, Leptinotarsa decemlineata
  Annotation=Beat-Va; Tribolium gene name from OrthoDB database= TC005765; Blast E-value Tribolium Gene vs. Leptinotarsa Unigene= 3E-19
taaaaaaaactactatcaattatatctgctcaaagtattactcaaaaactaaattaagaattagacactagaaaaatatttgggctatatcttcatcattagtatttgaatttggaattcacaatcaatataccaaaattagtacctacattggagattgaattctttcagaaaatatttccatttatcgacaaaaatagcaaccccaaaatatctttcttcatcgaaataacaattagaaatcgaaatattacaaaattggccgaatccaaatcattttccaactttttgactcaataatatattcaatatccactgatcaacctgaatcttggcacatcacatactcaagagtcttcctataatatacatatctggtacttcaactaatttacttgagaatcctggctatgctccacttcaccaccacaacccaaatcagagtccaggctatgtgaaaagaacggtggggtcgctttggtacaccatttgtcgaccagtgcaacttttggttgttgatgacttgcggatcgttgggattcctcacgaggacactgagggaggtgatctgcttgggtatgggcacgccgggaagggcagattcgcaacggatctctatactgttccctcgggaggccttccgttcgatcgggaaacgcagggtgattgagcgtgacactagtccgttcgaatctggttccgtgctcgaagaaccgatgatgtcgttcgcagcgggttcttgatcattaatcttccaggatagaataggttccggatctgcaaaatccgatatacatttggcagatacagtatctccttccaagtaagatgacgccaagccttctattttgggctccgatctgggtagagcggcaactatcacgttatgagtttccgatgctagtcgaaatgcaggagcttcgctggatatctcgcatctataagcccctccgctgtaggctctcgagagattttcgagtcttatcttgcagcggttctgtctgcagtccgtcccagagggttccaaatgaatccctgctacggggaatagcatcgtgtttggccgacggtgtggcatgtatctgaaaaactcgtggtcgtccttataccacttgacggcatataaatcttcggtgcccatgtcgaagtggcagtcaagttccataccatcacgtagatcggctaccggtggggcgttcatgcttgtcaagcgcagaccactcgattctccaattaattcacttgtccagtgtctgttgtcacctcgttgtgagtgatgtaactggtccacattctgaactgatctc

SEQ ID NO: 594 - DNA, 2575 bp, Leptinotarsa decemlineata
  Annotation=Novel protein (Zgc:91844); Tribolium gene name from OrthoDB database=TC030621; Blast E-value Tribolium Gene vs. Leptinotarsa Unigene=3E-39
taatatagtgaaaccacagttgctagggtttcgtagcttgtatagaacttttatatcggcttctgccggactatgtagactttcctgtacctgcagtcatagacctcaaagaagaaggaaacttccacataagtaaaactcatgatgtaaatgagtctcccgtattttgctcacaagatatcagtcccttagctaggctctatcacttgaatcaactaccgcgatggcctcaaatgtcactcacaagattttggaataggggcactttgcgacaggacacagaagatgtgctcagggcaatagcttatgatccagattgtgggcaaattgtgaaagagtgtgttagtgacattgtgtggaaatcttcagtgagtcaaagcctcaaaggcatcctcactgctggacttttcaaaagtgtgaaatatagtagtaaaaaaattaaaaagatgttcgtgcaataaacgtttaatatattgcttttttgcagacactccggcatgtaccaaatatcggactctgactccgctgactctgataggggtattcgttataaaacagacagtattcgtaacaaaagtaaaaatagtgaaacgagttctaaaagagatagtagtcgtgataatagaagtccaagaagagagagaaagtctctccacaaagacaagcatcgcgagaaacgtaaaacacatagctcacatcgtgatagagatagggatagaagaaagcaccaggaaaaagataaactggaaagagattgtaaaagaacaaatgaggatggtagtccagttactgatgttcagagtttacaacagtctctggcatctgttcaaactcaaaagcacccgaatgaagtcaaatacatgggaccagcattgccacctcatttacagaagaaacttggagaaaattcacagaaaatgattgaaaacaaagattcttgctcttttacccaaaacgtactagactcaccctctgaggaaacaaagaaatctgtaattagtcttatacattcagaaccatcaaatgcatctgatgatcattcagatctaccaacacaagaatctagattagctgttgattgtatgaaagatgatttatatgggccaactttaccggctgccaaaccaagtggtaatacggataatgatactaaatctggtaataaaatcattggacctatgctacctaactcgccaactcatatggagaatgaagccattgaacaaaattctatagagtcgaataaagagattaaagttattggacccgccctgcctccacatctacaaaagaatttagagaatcaagaactactttgcgggcctagtttgccaactatgcaggaacagaatccagagaagtatattggtcctgctctaccttcacatttgagggaaaagcttagccaagactctgagtgccaagagaaagatgaagaagaggaagaagtgtatggtcctgtaccaatgggggccagcttttcgaggtctcacgtggaactggaagaaagggctttggaaatgaagatagctcagttggatccgcagcaactgaaacaacctggaagggaagaatggatgttggagttgcccgcagtgaaagctgttaaccttggactaggacccaggcagttcaggaccaaagctggcccagatttctcagatagatccacttggacagacacaccaaaagataaggagagaaagaagcaaggtaaagaggaacccaaagtcaacctccagagggaaatggaattgatggagatgaagaaaagagacaaggaacaggaagctttagcaaagaagagtaaacgaaacaaagaaagtttggtggacatgcacaagaaaaaattgaaatcaactaaggacgatgctgctccactggaaagacgcccatttagtagggagacagaccttcaggtgaatcgttttgatgaagcccaaaaaaaggccgtgatgaaaaaagcacaactattagacaacaggttttcttcaggagaatcaaagtttctgtgaacatttcattcccaagacaatttaaagtttttttgtgcaaaacctgactttgaaataaaatttgttgtaaaaaatttgagaaattgtttggctatcactgttattttggggatgaatcattacataatagaaagctaagcaatttcgagtgatatctttgtagtctttattgggtatataatttgaaaacaaagatgttcacttattttcgaaattattaaaagaaatataagaagtcaatttgttgggagaaggtagatgaatttaatgcttattgttcaaatcaaaagttactatccttttcttattttaaactcctcatcaacactgttatgaaccttcctttgaatttcttgaagactttcctaaaattgaacattgctgtttttttacattatagtttgaaaaattttaataaaaaattaaatttcttatgagaattggaggttgtagtgccattcggttattatttgtaggattcaaaatttgtaatgtgtattcaataaattactctagtaaaccaaaaaaaaaaaaaaaaaaaaaagtaactactagacgtt

SEQ ID NO: 595 - DNA, 705 bp, Leptinotarsa decemlineata
  Annotation=Mitochondrial import protein MMP37; Tribolium gene name from OrthoDB database=TC030621; Blast E-value Tribolium Gene vs. Leptinotarsa Unigene=9E-112
aatagcaatgtaaacaaattgtttgacaggtaatcaatttaggttagtaggttaaggttttaaaaaaattccatgcatgttcataactagaaatacattatataatgttattattattttacaacaatgtctaccaaagtcacaatcgttcccccgttatacaagcgaattctatcccgatttccacaaaactttacgttctgtttcgcctatggttcaggtgtgaaaaaacagcttcagaacaaaccttcagagaatatgatcgacttgatattttgcgtcaacaacccacagtcctggcatgaagctaatttaaggaccaattcctcacattacagtgggctcaaacatttcgggcataattttgtggccagatatcaggagaattttggtgccaaagtgtacttcaacacccttattcctttcgacgatttttatatcaaatacggggttgtgagtaccaacgatttggttacagacttgttagagtggtccgatctctatattgctggtagattgcacaagccagtggaaataataaagaaacccttaagttcagaactggaaactgctctgcagctcaacctccagtcagcagtgcatgctgcattactcattcttccagaatcctttaccgaatatgaattctaccataccatatcaaacctcagttacagtggagacttccgcatgacttttggtgaa

SEQ ID NO: 596 - DNA, 2533 bp, Leptinotarsa decemlineata
  misc_feature (33)..(33): n is a, c, g, or t
  Annotation=Cannonball; Tribolium gene name from OrthoDB database=TC013143; Blast E-value Tribolium Gene vs. Leptinotarsa Unigene=0
aaattgtttctaaatctttcctctctaactacngtaattcatattcaagaatcacttgattgtgagattttcactatagttttcaaaaaacgcaacacatgtttcgctatacaatagcttcttcaggcgtgtctgtacccagtataaactttagtagtgttttttgaatacgtaatggattttcatcaagtatcagctgattccatcacatactgatgattcaataaaacaattccagacaatttggtaaataaacatgttttaagcatttgccaataatccattcataaaaacttcaaaattgtgatttgttggttcttcatggatatctacattattttaccacagaaatctgaattgaagctattattccaaaaaggtaatattaaattctagtgtataaaaacgaattaatttataatatacaaaaaaaaactgtcctaagtactagctccatcgaataatgccacggcaatcaacaaatttcgcctagtaaagtgcacgttgatcagaggcgaatttttcgttgcaagagtcctcatcaaatactcttctccagatttcacgtccggattgtgtgacacgttcacttcatcagaacttgtctcctccatcaacttcgtaaaatcccagagctttacgttgcaatccagcccacctgacaccaaaatgttcccgcaccgactgaaagacaaacagtgtatcgtcttctcatgcccagtcagctcggcgaccagatgtccgtggctgagatcccaaattagcactttgcaatctgtgcccgccgaagctagcattctcccgcatatgctaaatgctaatgcgtgaatgggagatttatgacccgtcatgagacggacgtggttaccggtcgtgcaatcccagaggcaaacgcgtctatcactcgaacctgttgccacgtaattggagttaggatggaactgtatgcaatcgacatccgaaaagtgcccagcaaacaccctcagcggttggtagtgatccgtggcccagagcctggccgtgcggtcgttggaactggatgcaaagtagtatcctaaaggcgagaacttgacgtcccacacgggaaacatgtgacccttgtagataacgagacacgtccatatttgtaggctccacagtctgatggtggtgtcttcagaagcactgagaaggagtgtacgatctggggagaacgaaactgagtataccgctcctgtgtggccgcacaaggtgcgtgatgtctcgccagaacgttcatccatcattcggaccaagacatcatctgcttccacattaacatcttcgagttgttcagcagttttcatcgccttaagcttctgcggcaccagagtccagacttttactattgaatcattgaatcccactgccagcatactcgaatcttcagtgatttcggcacagcagactgaataatttgcgttcaagagagtataacaacaacaagaaggtaatgattcaggccccaaagtaactcgtctggatgtttctctcaaagcttttattttttccagtttatcattgtctttccattctggtactggtattctatctggaggtggagcattgggatcagattttgtctttttagagaacaaaggatctttcttggcctttttttttcttcggtttatcaggattgtcttggtccgctccttcctcttcatcttccacgggagcagctgctaaggataccatatccggagcctttggtattccatagtatacctttgttttgttatcttgtcttttagcctcccctcctatagctcccgaagtggcatctatttggctcttattcctcgccacaccttcgtacatatcaaagtacaagtgctcctgaattatattcaacataacggcagcttttttgtcattcaaatgccttttcagcagagacagtgtatcccttgatatccttatgatgaactggttcgatttgaatgtttcagttaattcgttgccgttcatgtgatctcttttagttaccatagctagtttctttaaatcttcctgatagtaacaatcctgctcaggtccgaattttttcatcaaaccaatggctttttccgtgtgtccattgtataccagctcaaggtacatgtgtaccaagacaggatagagtattgtacccagctcgtgcttgtaaatgtcgagggatccttccacgaaccgcttgagctcagtgtaagaaacctcatatgcttccgggtctccatcacttttgtatcctgtcaagacgctgctaacgtcagactcttgttgtagcgattccgaatctgcgcctcctgttaggtttgcttcctttcgcaaaatctcttcagttccctttaagttgtatcgcttcagaatttgaagaatagcagatatttgagatttatccattatagaattgaattatcgccaagttatttgattaactcaatatttcatagggatcattctaatataaacccactaaaatattacacttcatcaacaatcaacataacctaatatacatcaaataaaaatc

SEQ ID NO: 597 - DNA, 1670 bp, Leptinotarsa decemlineata
  Annotation=Large neutral amino acids transporter; Tribolium gene name from OrthoDB database=TC011826; Blast E-value Tribolium Gene vs. Leptinotarsa Unigene=2E-148
gtcagtaacactatgtacaagttgcgatatgtcccagaattcaaatacacattctttaatcgtgaaaaagtatttgtgtcgtttcaggataagtgaccgccatcaaatattgaacggtttcggtgatattcctcaggtatttataatatttttgtggtttgtccttccatttaacacacatgaagtacacaggcactccagaaagaatcacggcaagtcccacaacagtgttccatggttgtttaggtatgggaaacacgataatgaaggcgcaacagataaggaacaggactggtattgaagtatgaatctttattggtctaaccatatttggttccttgtgacggatccataacattccagctatactagcaccagttgacagccacagtatttgtccatagtaattgatcaacacgtagacgtcacttataaacagcatggctagtgaagtaacgcatgtgaaaattaaacttggtataggagtgcttcttgtaatatgtatgaaggagaagaggtttggcaagtgtccctcttgcgctcctgtgaggaacaatcttgaggatgtaaataaaataccattaactccaccaaaagtagataaggccacgaatatcggcactaaccaatgtaaatttccaaacatcttcataccaaatgtcaacgcaactgcaggtgaactttctatttcaactccagtaagtacggtaaagtaagctatatttgcgagaacatatacagcggttactgtaggaagagcaatccaaatagcccttggcaaatttttgtaaggatcttgaagctcttctgtgacaaaattaaggaaattccaaccgccaaatgcaaataatcctgaataaaaactgagagaaagatccgatgcgctgtagtttccatcaaaagcgttgctgaagttttcggtgtgtccagatgcaagttgatatattccggcaagaactatgatccctagagcaaaaagtttggatgccgtgaatatgctttgtattctcatagcccatcgaacactccagcagttgatggcagtaagtaaacataaacatacagcggctagtaatctgatggaattttctggtggacgacattctctaaaaaatggtttggcggcgtactccgcaaatgtgagggcaacaatagcttgagtagtaggtcgaattattagtagagaaatccataacatcaagaatgcaccaaggggtccaaatgctacaaagatgtaagcatagtctcctccagatcttgtcaccgaagtgcccaattcagcataacataacgctcccaatgtggaaaacaacccagaaacacaccaaataataatagaaagaccaacggattttgtaccgagataaacacctgtgggagacacaaatattccactacctattattgttccaactattatcgaaaccccatttgtgagagtgatttttcgttgtagtttaactacatttttatcctcggggacacactcgccggtgacacttccattcattaatttttcactcattctcgtgatttaaacagaatacattttattcactgggctctatataattgcataagaaaacagaagaaacatggcaaaaagcacggcacagttacactcactttgtgctgactcgtgaatcgtgggcagcgaagcagggcagcgt

SEQ ID NO: 598 - DNA, 2408 bp, Leptinotarsa decemlineata
  Annotation=Forkhead box protein K2; Tribolium gene name from OrthoDB database=TC004006; Blast E-value Tribolium Gene vs. Leptinotarsa Unigene=1E-23
acgcctcactatccactttattcagttcaataatcatccaataatataaaataaaaaatcaacaaatttaaaacatttatgtatacagtacataagtcttttatgtacatagtttcggaaaacaaaaattattaaatacaataaactgttatatttcaaaatttacagaaacaatattcaactttactaaaatttttgactcttcaagaaacaacattattacaagtccctattcaaaaaaacaccttttcgcttcagtaattaatatcgtatatataagttattttgggttcgtgaaagaaatacctcctaaatagagaaaatactattcgtctcgaatgtgtgcgtccacatccaagacacgtctacttaaaaattcaattttacggacttcttttatttgtctccaggttttttgaaaccggccctagtgaaaattggcgaacttttccttttgcaggttctcattccatttcgaatttgatctgatcctgtctcattctcttcatttctggctcttgcagattctccatactttcaccaacactcgaaggactgtccatgctttgttcgtctaagtgcctcttcaaatctaaccctaggttgccataatttccactgctgtaaggtgaataatttgctgtttgcacaatgactggttgtggagaaaatgcaccgggtgataaggatctttcttccatagtaggaattatatatttttcttccctatattcttgtccgttagagctggaactttgttccatactctccagtggaggtggtagaagaagtctagcctttgtcgctcccactaaagcagacatttgctgatggccgatcatgccacctgatccgggatatgcgaagcttgacttcccggacttcctggagctgactggctgatatccaccatgtgctccataatcggggagccttctctagagagagactcgggcgtcatcatatcattcatgttgacgtgggaaggcgacgctggagcacttctggaactcaaaccgaatggagccctaaaacaggaaactcctctctgccttctccgcctaaatgcctgttcaatcagttttgactcggattgtggatcaatcctccaaaatgaacccttaccgggttcttcttgacttcttggaaccttgatgaaatatctattgagactgaggttatgtctgattgagttctgccaacccttgtcggcggtacggtaatacggatagtgtttcgttatgtaactatatattccagacagggtaagctgcttgtccggtgaacttcttgcgatcgcttgtactataagctgcgcataagagaatggaggcttcgaatcatctttattgctactactgctactaggcatataagcccctgcatcactcatcactacgggttgtattgaatttccattggaagttgattgcttataatctggactgtgactacgagggatcgaatgactgtcgtctctataggctacttcggcagcatacctcgctgccatcgttagatcagcttgaacattcctctttccgtggtttccagtatgtccgctatggccacctcttggactcgcagggcagctattggcagcactgatggtgccggtgggtgatggaaaagggctagcatattcaccatcaggaatattaatcctaagggggttggtagatgaggaagttccgccgccagaccgatccctcatcctcacaggagacacatcgcgtacggggggtggctccgaattatcgtctatcagcgattggaaagacagtctaatgtttgtactgggaaacctaaaagtgcatgatttgggtaaccggatcgagggggctcctttcctctgaaacacaccatccacgaagatgccgtttttcccgttacacaacatataaaacgaaggatgttcgaaaaaaacctctaaatgccttcgcgagataaaactagaacgtcccatatttacatctacaacaccacgtgaactgtttctacctataattatccgactctggcgtaccagatattcaatttcgcgaccttctattcgagctatcggttcaccattgtcgtcggggctccactgcactttcgaaggactagcgggggccgatttcaaagccagaagagcccatgcatctctctcggaagtcatcgtatatgatgtggacatggtgattcactcacttcacagcactttttcaacaacacaactaaccagtcagtgtctcacttcactgtttacctacaaaatgcagcaaacgtgggagtcacctgtaatattgcttcgaatgtgttgatttcataacgctcagtcgatagaaatgttggtaaacacgtgagattggtgtgaaaacagtcacactcgggacagacacatctagcaatttaaaacagaatat

SEQ ID NO: 599 - DNA, 2094 bp, Leptinotarsa decemlineata
  Annotation=CG6619; Tribolium gene name from OrthoDB database= TC002393; Blast E-value Tribolium Gene vs. Leptinotarsa Unigene= 0
attacagcctggtagcttctgaactcgtagaaacattttttggatattcatttttagaatttcgacgtgcgctataataaccgaaatttgggtcagtcgggctgatgacattctgccttggactctggaagaaacgactttcagttgtgtccggccctggagatacaggctctaagcattcacaggaaagactcggatctgataaagcttctgaagagtatttcggaactgacagcaaactttctgttgatttagtgggttgaaagtacctccgatgggtatgtggtgtatactgtggttgtccaggacagttaccaccagtctgcttgtctaccctaatgtactgtgtaccttgtgctttagtatgaggccgactgcttttctgagcacatttggaagaggtgtctaggtatccgtacccaaatccataaccaccaaacgctttcgttgttaaattgtcccaagactttggtttattcacttggttgtattgaacgtagatcgtttcttgctgttggggttgttgtgagtatctttggtgatcgccatgtttattagatttaacacttaactgtctggaagtatcacaggaaccgtcccaatagagggtgtcggtgcttagagaagttgtgtaactattagctgagctttcggctactgtagtaggtactacattgctgatttcgctagaagtacacgagtgtagactgcactggcttactaggcctgctccgatgtggaaataccttctcggtgcggaaaagctttgagtatttgcagtcgtctgcgatgactgggaatgtggccgagatcttgtctgtggaggatcagtctgagtttcctcagtcttcgagtctctttttctatggtccttatgactacgagatcttcttctgttggaaggaacgcatcgcggatcacaacacgaacttgctaaatcgtaagcatccagactggtattatcaccgttgctcgaacctgattgtacacaaggattgcagagctgtcccgcgtaactctgacagagagcgggaggtttcttcgctttttccatgctgcctgctatatgagtttgattgcctctggactgtctttggtcgcaaggggtcttgacaatgaaattttgttgttctttataacggggcggttcgaaggtaaggaggtattccccgctgctactggtggatgggtgaagcatatacctatactgcgaatctaagtattggtaggaaaaaactaaagggggcgttggctgtttctgttgctgagctactttcgccacatcttctgtcgaaactgttggtctacaatatgaataagatgactgagtaggggttggcggaccaccattatttgcttgtgaagccttttttcttgctggcaaactatgcgttttccattttccctcgaaaagttgcctttctctcaaacataaccgttccagttcttccatcttcgtttggagtattctttgaagtttgatatatctcatatgtaactcgaccttccgtacacaatcttcaaacaaaaccaccattctcattctagtatcacaatttttgatgtaattaactagggttttatgatcagccttctccatatcagtaccatttatggataagatgacatccccttctctcataccagccctatacgctggaccgtcgtagtccacataatccacgtaggtaatcatttctatttccttttctttcttgtaatgtattccataactttgaagtgtaaatccaaaagatccattctttttttctacgatgattgtccgtcgtcgtcgatcttcctcaggtttggtaactgtaactcggtctgattgaactctttccaggatttgtgatggagacgacgaagtgcaatcgttatcttgttcgatctgcaactgcgactgactttgtggattccttctcatctttctcgccaaaaaaactatcaggccacatcacatccaaacactttcactgggaaacgtcacaaaaaccgattccatttctcagaattggtaagaaacagctgttcgatggaagtcactgacgagacgccgacgttgcgatgccgacgtcggccattttgagcgac

SEQ ID NO: 600 - DNA, 2895 bp, Leptinotarsa decemlineata
  Annotation=DNA topoisomerase 3-beta-1; Tribolium gene name from OrthoDB database=TC006688; Blast E-value Tribolium Gene vs. Leptinotarsa Unigene=6E-114
gatatcaacaaaaatctacattttcaaagaatcaaatgttagaataaaaattaagagtcatcataaatacaaaaataaattatagaaataaaattccaaaatattccaattttaaaatattagtactgaaaaaaattctatcttagaagttattttaataaacctccattgaaatcggcaaatagatctcaatcataatatgtcgacaaacaaaatcactttgtagtatttttttacacaaaatacgctgccagctgcgccattttatctttgggctgctttcccctgcctgctcttcctctacccctaccagcagtgaccttcccccctctaaaagttcgtgggcgagtattaacagccaccttaggtctgtctactaatcttgaaaaatcaggataacagaagacacaacctttagcttcagttgcccctttgggaagtttggatttttcttgtttgtattctacagtaaccagttgcgagccacattcgcagttatcttcgaggaccgttattttttgagcatcatcaaataagttgattatggtgtcacacctattgcatcccaatttccatttaggccctgaagatgggtccaaaaccagtattccgaattcacactcagcacaattacaaattccattggaattcaaactataaaggcaagtaggatgggagcatgaattgcaaccactgccttttttcatatctttgaatggagggttattatagcaatatgggcaaaagacgaagcttttgcctttatttcccattgtccaggaaagtaactcaaaatcatccaatggacatttcaactccctaaatatttttattattccattctgcggtacattgaatgtttcatcacaatgtgggcaatgcagtctggcaggtttagcttgaatatatttcatgtatcttcggcatttgccacatcttgaatgtgcccttccagttgcacttaaaggtgaaaatgatacttcgaacagttggtccataccatcaatatttttcacaaaatattgaaacttcaatttgaaaatctccacggtgtgtttgagaacatcgtgaaaatttgcctttccagcagctatcagattcagttgttcttctacagctgatctcattgttggcaataccaactcctcatctatcttctgatatccatgtactaagacaatgccaagcgttgttggtttaagttttcttccaggtgttactgtaacataatttctttggcagatgttattgatatgaaccggtatagaagcatcggttccaatcccgtgtttttccattaaagtaataagttcagcttccgttaggtaatcaggaggagatgtctggtgttcggaaagttttgcctcctttataggaacagtttcattttcatggagattagggacgatttcgtttttcccgaaagcctgccaagtcataatagttgtgaagcctggatctaaaagagttttaccagataccgtaaaaacctcatcgttgattatgattgtgactgtggtggtgagatatttacagtctttggccaaagtcccaatgaaatgtctcgttatgtagtcatatagtttccatgaatcaccatcgagctcgtttcgtgaagctgctttcataggagtgataggaggatggtcacctgcatcatgtccgctttttggtcggtttacaccattatttaaaatctgcctcacttcatctccccaatcggaactattttgctgttgtctcaatacaccaatcaaatcgaaattttcaggatacctagtagtttctgtacgaggataactgatgtatccttgaatgtacaacttttccgcgatttgcatagcatgatggggacccattcccaaaccagaacttgctactctcataagttcaaccgtattcagagctgaaggtcgaggtttggatttttctttggaaatcacactcactacttttgcctgtttttgatccttgacaagctgcaaaaacaaattagctacttctttgtcaaaacttctaaccctctgccaatctaatgttacatcctgattgtcggtagttttaacagtgacctgaacacaccaatacgtttctggcttgaatgtttgtatggcatcatgtctctgaacacaaaaaccaagggttggagtttgacacggtccataagatatgagtgatgagtcaagatctccataacgcccttgaaaaaacctagtttgaaatcttgtaaaagcacatcctattcggagatctagttcctgtcgagcgtcaacgcttttagcttcattctcatttgggtgacccaatgaattgaatgcagcttttatatccttctccgttatagcggaaaatttagcacgataagtcaccttatcggaatatacacttcccaatacactactcgcgactgcactcattacttcaaaacaaatattttcgccttctttatcgcagtcaagccataacacaagattttcagcacctttggcctcttgtgctagaaatgaaggcattttcaactttggcattgcttcttttttctcaatagggcatgaaaagagttcaacaggatcaaccctgtcccaattattgtatttactaatgaaatctacaccaaaaacgtgtccacaaacagaagtcattttaaatcgagccggagcacctaaaaaggtgccgttccattcgtgaatagaacaggctccattgaaaccctttttacttgtattattcccattactgagaatgttggctaaagaagctgccaaagacggcttctcagccaccataaagacacttttcatatttcaaaatataataaatttttcaaaggatcccatacaaattctatttatttagagttcaaacctaaccaaattagacaatgacaatactgcc

SEQ ID NO: 601 - DNA, 2109 bp, Leptinotarsa decemlineata
  Annotation=Arylsulfatase B; Tribolium gene name from OrthoDB database=TC006555; Blast E-value Tribolium Gene vs. Leptinotarsa Unigene=2E-19
gacattgttgatgactctaaaacgttggtgaattgttttgtgataggctgccatcaagaatattcagtatggcattgaatgaaattatattcgttgtttcattcttgttggcaacatgtcgtctagagactacccctgcaagacctaatattgttttcatcttagcagatgatctgggatggaatgacgtcggataccacggttccaatcaaataccgaccccaaacatcgacgcactggcatatgctggcttgatactgaacaattactatgtatcagcaatttgcactccttctagaagtgctctcatgacggggaaacaccccatacacactgggatgcagcacaccgtattgtatggagcagaagccaggggtctgccgctatctgaaaaactgttaccccagtatctcgaggagctggggtatgtgaatcacatcgtcggtaaatggcatttgggatgttacacgaaagattatacacctttatacagaggattcaagtcccatttaggttactggacgggccaccacgactactacgatcacactgcggttgaaaatccaggctggggacttgatatgagaaggaacttggatgtagcgtacgatcttcatgggcaatactccactgacattttcacggcagaatctgtcaagttgatcaacgagcacaacaagagtcagcctttgttcctctatcttgctcacgcagcggtacactctgcaaacccgtatacttctctaccagcatccgatgaggtggtcgagcaattttcctatatcagtgactataagaggaggcgttttgcagcaatgctcagcaggttagaccattccgttggagaggttacaaaagctttgcaagaaaacaacatgttggaaaataccataataatattcagcacggataacggaggacccgcatcaggattcaatctcaacgccgcctcaaactatcctttaaggggagtgaagaacacgctatgggaagggggagtgaggggagctgccctgatatggagtgctctcataaataaatctcagagggtcgctgatcagatgatgcacgtgtccgattggttaccgactctgatagaagctgcaggaggagacgtcagcaacatatctgatattgacggaatttcaacgtggaccgctttgtccaatgatgaaaaatccaatagaactgacgtcctccacaacatagatgacatttatggaaatgccgctctaactgtaggcccgtggaaactgatcaaaggaacgacatacgatggcacgtgggacagttggtacggcccaagcggcagagattataactacagcctatctctgattgaaaactccgcagcaggacaggccctaagggccatcaataaatcagcgtctcgtttgaaaatggaagcgttacgaggggaggcgacgatcgactgtacgccgccagtgaattctaccggaaattgctaccctctggaatcatcgtgtcttttcaatattctcacggacccatgtgaaacaaacaatttggctaatgaatatccccatattctccaaagtatggaaggggttctagaacgatacaacaaaacagcagtaccaccaggaaatctacctttggaccccagaggagatcctaaaaattgggattatgtttggactaactttggagactacactgaatcaacaacaatgatagatatatgaagcatagaagatcatcaaaatttttatgaatatgtactgaaaacaaatgtgtcaaaatcaaagtaataagaacatttttaggggtggggttcaatgatgtcagtagtactgatcttaaccttcattcttaaagacagaaagtacatatagactgatccactggtaactttgctattactggagtgcattaattaattaagacgcaaaaaccaacaaacagtaatcgcatttttacgactgtatgcaacattttctctggttgaaaattatatctatttctattttctattaatttgtttataaactctacagatcatggcccagttacagagtaggaaaggtaaatatcacaaatggatttgtacatcaacaaaatagacaacaatgttaattaaaaataatt

SEQ ID NO: 602 - DNA, 4916 bp, Leptinotarsa decemlineata
  Annotation=Protein takeout; Tribolium gene name from OrthoDB database=TC013559; Blast E-value Tribolium Gene vs. Leptinotarsa Unigene=2E-32
gattaacggcgagtcaatcagaacaggtgctcaactttttttttcaaaatgtacagtgtgctctttctgatagtttacctcgcgaatgccgtgagatcgacggaaaatgtcacattcgaaacacctgaatacattcttccatgcctcaaagcagacccggaaatcaacaaatgccttgtaaaaactttcaaccatctcagaccatacctgaaggagggaatcaaggacattgatgttcccagcctagatcctctcaccatcgacaatcttatcatggagaacggaagaggtcctttcagaatcagagcagccttttacaacatatctactaacggagccagtaactattctgtcggtaacatcaagaccgacctcgacaattacgtaattgaatttggtatccacttgccacgactagaatgcaaaggaaaatacgatgtcaatggtaacgttctactctttccagtgaggtcaaaaggagatttttgggccatattcttggatgtgaatggtgctgccaaaatttttggaaaagagttcaggaacgaaaaagatgtgagattcatgaaaattgacaaaatggtagtggatttcgaaatgaagaagagccgtttcagaattaaagatataatcaatcacggaaacataataggagaggccatgaaccaattcctaaacaataacgcagacgaaatcattgctgaaatgaaaccggctgccaacgcagccatagcgaagcacttcaagggatttttgaacggcgctttcgtcaaattaccgctgaaagtatggttgcctgatgcgtaggagttgagtataccgtatcagagcacgtttcacggaatatcattgcacttttgtttgtacctgcgtagactaaacaaagaatgtcccatcgttaagtgcaccatttcgtatgaactgaactgttcccagagtgacatagaatagtgctacaccctgccatttgtccgtaaatagaccttcacactgataatgggataacctaggtttagattttttacaatttcttctgccgtagttttttcaaaatcgattgaaaactatggtcgtgacgtcacttacattcgattatgaacttggcaacaccgtaaagtttattcatattgcataattgaattttcttcttctttcggtattcttgttgttctaactgttcctgcgaaattgccaacttgtttttgacgtcaatttgttgatttgttccggaactgaaaagcatttcatattacgaaacacttacgaacaataatacctggaatttttagaaggggcatttgattgagtagtactaaatgaatagttatgttgtatattcattcagtcctattttctgcttcacacaattcctatacattttggaacatggtttgaaagaggagataagtctcgaaggtaatgacgttaggttaggttaggtcgaaagtgagtgggtcgattcgaccctccaccgcaacccgcaatgatgattcagacgacagtgacctgtgaggaggtctgttagacaagattctgccagaagtccataaatcttcttgcaatccaggtgttcaatgtttgacaaaacctagtagtgacgtcacatacatttttgaaacttcgattttctttcgaagttcaaaactttgggtgttacttcatgaaaagtgaaccgttttctcatagaactgaggaataatattttttgttcggacagtgtaaaggtgtatcgtcaaactgagaaaaaagtcacgttgtagaatagtacccgaaagttttttaaagattttggccaccagttttaggtgtagttaacgaaaatgactaatcatcaacttagttcagttagtcgttatgatatactgaaatgtgtaaatacccacgatctcaatgcatataatctagtgtggtaatatacctataataatactaagattcttgaagacacacaccgttaaaaatagcaaccctgaataggtcatttgattttgagaccggaagcaagaaaatcatgaaacaagtccaattcagttttcaatacatgtttttacgttgagaacaaccccttattcgcaacccatctgcataacaacctacacatcgaagatttcaaattagaataatagatctttcaattttgtatcgaatgctgtaaaatttttgttatcataacattaagcaatgttgagcagttcaatattgtgcattcactttccaactagaaagtgaagcaaaacagaagaaattacttcattgaatttatcttacatacagtgatataaacaaaattttgttgccttttctacattctgaagaatatcaggtgttagtagcctacataccacatggtaatccggtaaactgtccaaaatacatctcttagacttttggttcaaaaagtcctgtagagtcgaatcgaggaatctagctggtcattcctttccaatccgtcgaccaggaaaattattatcgagaaattatcgcacttgtatcatgcagtgagagatcgttctatattgctgaaaaactaccccatttcgcagtagaggatctgaatggatttcgttgttagtgccttaaataactcaatcattcagcatatcgagatatccttcactattctggtctgctacctactatcgttgtaatgtcagaaatattacaggaaggggtacaacattcaaagacatttcaaatatggtgtcaatcgacttttttacctgttagaaacttttgacaagagggttgacaagagagagggtggctgacaaggtttgaattattacgtagatatgtatcttcctgaaaaccaaagttgacgtgtttcaacatttatactctagactcaatatcaactgactcattcagggtagcttgtcttaactggaaggtatttcatttacaactgacgtttaaatgtgtcagtcttggaaaggaaaatataataatttagtgaagaaacgcaaagaagattagacggaaatcaccaagtagcttgttaactctaaatctcgctgacaatctagagagtgtcacctggtatgagattgagacagaataattagcaaaatgacaaacagaaacctggaaaaggtttggaataagtgatcaaataaaaaaaaatgaatcgaactggttcgggtgaagatgaattcccagtccctttttgtccatttaaggtagtgaaaatgtctgagaatagctagaaagaataatatcgcatcgattaatttattgagaagtactggtatcaatacaaaaaatgctttcattttttggcgttattagagaagatattaaaggatggaaaatactttctcattggtactttttgagctctacaaatttttaacccgtttcgtttccgaacaatcatcaccgatttaatttttaatgtggactggaaaaaaaatcacccattgttataagttttcatttatagcggtaacttcactgatttatcatactcaatcgaaattttgtgaatttcaaaacgacacttcaataaacttttgaatgcataactttttctttattcagccgactttgtatctactacactttctgatttcacaagctggtcctccctatcttgaacagatagtatatgcagaaataatattttcagaagacagtacctgtaaaaaaacttccactttaaaaaaattcattgctaaatagctaggttcattatttgacatataatacatactgagaaggtataatgaatttcatcaagtcctattatcacataaaaaaagtaagaacaaatcaaaaacaaaataataaaacagatacgtttaacggatgataaccccactcaatctataaaaaaacggatactttggtttcagttagtatgcacatgtataaatatctctagtttaaagatgtttgataaaaacaaagacttgtagaattccatgtttcaatcgttgataccagaatatttgtcacataaagtttttcaatgtgtcggctatattagcattttaacttttttagcgtcattttctgaattgatcaaagagtgaaaactttcacagctatttttcggtttgttgagcgtggtctgaaggttttcatgtctgacattccatttatgtttgcagtagacaataatgaagtcttcgatgatgtttaccgcagtcgtagaagaaacatcgcaaaagaaacctggaaaataatcctgatacgacttcagttcagttcttgagacctttttagtaattttgccagtcctgagttttcatcattttattggagagtgcattaacatgtgcctcataatatggaggtttaccgatatcaaacatcagaatgatgttgattagaattattatcatcatttgccaattatgtttgacctgaattagtgtgtaagactctttcatctgaaggaacaactttttttatcttaggatataggacctttttatttgaaatgttttcatgcaactggatcattcccaaagttataaatatgtccaaaccttggttttaagtgaaattttcatagtttttttcatcattatacatttctcgctcaatttgtgaagcagatgtatcgaggaactcacctttaattttcatttgttcatataatttgcttgaacttttcaaactatgaagaatgagctttctacttacacagcaagaagggaaacataaataaggctcagtttcagaattgtaaccctaaattttcattacttctacttagcgttttccatttgatggctttttttgtacatacaatatgagaaatggaagagggaaagcactattcgctgtcattcagttaacaacttctcacccgttgcaagaggacttcggacaaaaatacgaactcgtctggtgtattaatagtattaagagaacttcgtgttggtactgtttttctattgttatttatt

SEQ ID NO: 603 - DNA, 2228 bp, Leptinotarsa decemlineata
  Annotation=Zinc finger Ran-binding domain-containing protein 2; Tribolium gene name from OrthoDB database=TC010666; Blast E- value Tribolium Gene vs. Leptinotarsa Unigene=4E-7; Blast E- value Tribolium Gene vs. Leptinotarsa Unigene=0
gattttgatcaaagtcaaaaatcaacaatatgccatcagtgattctgaatcggaaattgtgagaaagttgcattttaaaagaactttcataactttaaacgttatttgtaaagataaacaataatgtccgacgaagaagagctgactcctccaccacctcctagcctcaaaagccctagcgccgaaggtgattggacatgcgaagactgtggaaacgtaaattttgcccgcagaaacaattgtaaccgttgcaacaaggggaaagctcacagcttggctgctgctaaaaagagaaagttgggaacggaaatcggcaaagcggcagcagaaaaaagcaaaggcctttttagtgctgatgactggcagtgtaacaaatgcggtaacgttaattgggcacgcagacaatcctgcaacgtctgcaatgcccctaagtttggcgaagtcgaagaaagaaccgggttcggaggtggctataatgatcgaggtgtggttgaatacaaggaacgtcaagattccgatgatgactatgacgaatttgggaggagaaagaaaaggcgacgaactcactcaagaagtgatggggacgaagaagaacgtgttgaaaaaaaaagtgctagaagcgagaaggtgaaagaaagaattattgagaatgaggaagatgaagaagatgatgatgacgacgacgatgatgatggagatttgtccaagtatgatttatcagattggggagatgttggtcaggtagacaacaaaaaggataagggcagaaacaattctttgtcgccctctcgtaataactattgaatgtatattacctattgatttttattttttcaaattgaaaatagagaatatcagctggtctgatttaacatttttatggtgatgatcaaactagattaatgtgtagtctgcaaatcataacttgctgttaattttattaaaaattcggttttttgcttttaatgtgtatatgattttaaatttgttggactcagtgtctgacatgaaaaataacttggaatttgaatacaatacaagttattaacatataatgaacaatttatccttgacacacgatagcttgctttagttatacttcaagattttaaatatattttgtcttaaaactcatttctacattagcctctaaactctctaaacaaattatgtttgtattttggtcatttataatgactgccagtgtggcattacttgcattacagccgaacggctgctatcaaattattttttgaatggaagggaattttgtgacccttctcttgattgttcttgaaaactatgattttttttatgtaaattttgtctgacattgatatcttgtcccgttcaaaagttaggaggggcagaagtattgtcatcatgaaaatgttaaataatgtaattttaagattagtgaattattccaaaacttataacatttttttcttgtcaattccctcaaagaccgtaaataattttatgatgatgattttatcatttttctcaatttattttcagtgaatgtttattatttgtgtccgatttgctgatgttttatcaaattttgttaaatgtctttttgttaatgtgctgtaaccaaatatatgtaattgtatgaaacaattcattacatggtttttcaatgtaaaaaccaattttatatatatatagacatatttacttgcttctaacttcaaatttgtttttgaaaattacttttatcgagtcatggtacagtttttgacaaatttaaataaaaactgttattaactccaagcaaatcacgtaatgaattagtattcaacatcaattcctgtttttctgaaattgtgtttcataattttgaaagtattgacacacatcgctaattactgttctgaaattttgtttatttaattttgaaaagttgacatgtcggatttaactcttattgttttaaatatctgttgttctgtccaatggaactaaatttccattattttatttcatttcagtgttttgacaaatgtctctatcgttcttcagtagccaacttggatagtaagcatgtgtcagataatgatagtattggaaacctgtttgaggttctctggcttagttgcactgagttttatgatttgtatcgttcagagtagatgtattttattaggtaatttcattcaattactttattctggtttaatatatagtacttgcaggttcacttattaaatatatgttgacat

SEQ ID NO: 604 - DNA, 3116 bp, Leptinotarsa decemlineata
  Annotation=Tartan/capricious-like protein; Tribolium gene name from OrthoDB database=TC011379; Blast E-value Tribolium Gene vs. Leptinotarsa Unigene=0
agaatttcgaattggtacagcgttcaaggataacttatgacgaaaatacacaagatgcattttttggttaaatgtgctgttctccttgcactggcagaatcgacttcgagtctcgaggattttaggccatgttctgaaatatcgagagagctgcgatttccttgcacatgtgcgctaggaccaatagagcaagctttggatggagacccttcaattcacatgaattgcgatagaattgtattcccttcagaaatgtcttcattaccatacggatcacccatagtttcttatagacaaaggtgggccggaattcagtcattgccaagacaggtttactcgtcaacagaccttcctctccgaagtatagatctttcaggaaattctttgaggaggttgacggatagattgcttttgagtcttcaagcaactttagtcgaactcagattggcagataatcttctgggggatactttgaatccaatattctcaacaacagaattgcgtggtctgactcatcttcagttattggacttgagtgggaatagtatacgagcggttgaagaaggaatcctagaagggtgcgataacctccaggagctgtatttagacagaaaccgattcaatgcagtgccgagtacatcattgaacggaccaaaggcactgaggaagttatcattagtaaacaatcgaatagataccatccaatcacaagctttcaaatctcaagaatatttggagtacatagatttaagcaataatttcatatccctcattgagagcagtgcgttttcgcctctgcaaaagttgaaatttttgaaattggctcataacagactggccaggttcaatagcgacgtttttcaaggaagtgataatcttatactactcgacctctcagaaaacttcatcagtgaatttccaagcgttgcgttgaaggccttcactaacttgagatacctaaatttgtcatctaatttaatacagaatttggacaacacacatctttcctcccttcagagtctttatcaacttgacctgggcagaaataacttggcaaatatagtacctggaaccttcttgggacttaaacaattgactaaactggatataagtgtgaattcattgagaacgattgaggatgacgctttcgaaggtttggacaatcttgaatttctgaacctgaaagacaacaatattctcctgatccctgcctcagctttaggtcgcttaccgagactctcatcattgcaattagactacaatcgcgtcgcggccttatcggccgatatattgcgttcagtggccgacaaagtaactaaattgattatttcaaagaacattgttcgtgaactacctcctgcatcgttccaatactttcaacagttgcaaacgttggatctgtccagaaacttgttgaattccctgaatgccgaggcatttacaggccttgaaaatactttgattgaattggacttatctcaaaacaggattaccaatctggccggggcaccgttggctttattgaaaattgagaaacttgacctcagtgacaaccatcttactgaaatatcagccaacgctttcagtatggtaccaactttacaacatttaaatctcagtagaaatattcatttgggcaatatccctgtaacactccttcataagcttcaagagttaagaatcctagatatgacccaaggaggcgttaaatcactaccagcagaatttttcagaatgtcaaaatcgattcaagaaatatatttagctcacaacagaatacaagatcttggagagggagtctttagcaactttgccaacattagctctatagatttatcttacaataacatcacaagcataaaacctggtgctttcgtgaacgtcatgaatatgaaaaaactgatcttgagaggaaaccagctgagctcttttaaaggggagtttttcaacactggtaccagcttggaggtgatagatatttccgaaaatcaactgagctacctgtttccatcttcatttcgcattcatccgagactgaaaaagataattgcctacaataataaattcaactttttcccagcagagctcatagcccacttgcaattcttagagtacgtggacttgtcccagaatcaactgaaaacgttggaggagctggattttgcaaggttgcctagactcagaacacttctcattgctaataatcaactagagtctgtaagcgatatggctttccacaattcttcccaacttcaggtactcgatctaagcggtaataaattggaccggcttggagatagaacttttgaaggtctagttcgtctggaattactgaacctggagaggaatgccctggcagatctaccagagaacattttcgagcgtgtgcgattgcaaatgctggaaaacataaatttagcgaggaacttattcgaaatagctcctttgaaatctctgcaaagacaattcttctttgtatcttcggtggatttatcttataataaaattcgggagattcccacagatgatagcatcatggttaatatcaaaaagttggacttgtctttcaacccgttagtagaaaaaactgttacaaatattcttggtgaacccaaaacgatacgggaactgaatctagctggcacaaatatcagaagtattccgcggcttgaaacgccctttctgaagaatttgaacctatcacataataatatttcgtcactggatgcgcacgtttttgaaagaatcaccttgctggaagaactagacttgtctgataacaaaatatcagatatttccaattattcaaaaatttggaagttacttcagaatttgcagggtttgaatatttccaataatccaatagtgtctatttccgatgatgatttcgctggactggaaaaattgaggtacctgagtcttcactctttggaagagtgtagtcgaatagagaaaaaagcgtttaaagaaataccaaatctttctacattagaagcgtatggatatcccaaactaggatatatcgatattcaaggattgcttcaaaatatgccgcttttagaaaaaattaatatcgaaatcaaagatgcagctataggaaaagatcaattacagtc

SEQ ID NO: 605 - DNA, 2507 bp, Leptinotarsa decemlineata
  Annotation=Leucine-rich transmembrane protein; Tribolium gene name from OrthoDB database=TC002411; Blast E-value Tribolium Gene vs. Leptinotarsa Unigene=2E-175
tattatgtcagatgtgttatcataaaaatgtatggcacattttagtcgaagttttattatgtaaattattatcacatttcaattgtcaacatttttctggtccgaacataacataacaagaaaattcctttaccattatacctgtacttcaaatgatttccatctgctagaggtgacagtgatcagatcgaatctaagtagaagtagtactaaatgactagtaataagttattttcaaaaactaatgtcatgattctttcaaatcagagggtttctctattcaaggttttctgagttcagatagatcatcacgagaatttttgttattgctgttattgtactgctggttcagtaacagttgattttgtgatgacaatacatcaattctagaccttagttcttctatttcattagcgagtttatttatttgttgaccctgtttaatggggtcaaaaatttgtgccgtatgatttgttcctgttggtcgaataatttcatcattggacgctcctgtaccaatatcttgttgcaaggtttcgttactgttttggtctgtattagtattttcttgtggtttcattgcaatactttcatttttcacaatggaaaatgagttactctccactgtaatttctgtatttgtatcagactgactgttttttggaatatccaactggttttgttgatcatcggtttgctcattttgcaaagcatttccagaattagccgatatagctgcaggcaacaaaggagttgtttctggaacgtatccaaagaatgcggtaggctttgaagtggttggttgttcactcagaggaggacagtgagacactccatatattctagtgtggttgatttccattatcgacattatgtctggcaacgcagcatcacaaagtatggggttatcttgaaggtagattttcaaagtgtcccatgttccttcgtgtactccatgttcaatggtacaacgagtttttgccgtcaaatcttttccgatggcaacaatttgattgctggacaaatcagcatggcaaagaacaggcaatccatggaaatctttctctagtatggtcaagtaattatggcttgctctcaattcagatagacgaggaagataagtcttactagtttcttccaatgttgttaattgattatgcgaaatatctagaagccgcaactgttccaatccgataagatcctcgggagatatcctttttaatctgttgtagctcaaatcaagtctcaagagctcggatagtcctgacaaagcaccgttcaaagtttcaatttggttgtgatccaatttaatttcattcagtttaatattccattccaccaaattaggagttggacctacgagggtagtgattttgttgtacgacagatctatgcttctgagcagcttcaagttggcaacttcttgaaaagaaaattcaacgatttggttctttgttaagctaaggaaatgaagccttctcaggtttactagcgaattattcagagtatatatttcgttattgccaagtagaagggactccaagttcatgctcgctggaaagtcggcttgtgttagcgtattgagttgattattctccaatactatcctcaataatttatcatttttggaaaaagctccatcaagtgacttcaatctgttattgaataggaatattgattccaacgccgggtagttcttcagttgatttggcaccttttcaagtctgttgtgggaagcatgtatgtagttgaggttgggagcggtacgtggtaactgaccatccaaatttgtcaaattattactgttgacaaaaagccaaaacaactcggaaaggttcctcaaagtaccgtttaaatctgaaatagagttgcgtcccaaatgtagtcgctgaatttgaggcggaattgaatgactctcaagttgtgatatctggtttccggcaagcatcaggcattcgagttgaggcaaatctgcaaaactagattttcgaagagacttgatattggttcttcccagatcgagggtgtttataataggcatttctttccacaacagctctggcacttcatctaacgtgttgtatgctaaactgaggtaattcactcttgtgagccctttgaaggattcaggattcaaaggtccaataacattgtgattcaacttcaggttctcaattgtcatattaagctcgctgaacgaccgataattgagatcttctaatgtcgaagaggccagtcttagagtcactttgtcacccggttgaaagtgcccccctagagtgcttatcacctgttggaacgaagacatcctctcgcaactaatcgtagtgattttgaaggtgtccaacctgcaagaacacggcgagatttccttccacatcggacagtgctgcaatccggaagaaacgccgaggatggacaggagcaggaccgacatatcgaatccgaaatttaccatcaggtcacttgtttcactttattttaatcgaagtcggcttcgcacattc

SEQ ID NO: 606 - DNA, 3581 bp, Leptinotarsa decemlineata
  Annotation=Symplekin, putative; Tribolium gene name from OrthoDB database=TC010414; Blast E-value Tribolium Gene vs. Leptinotarsa Unigene=0
atatttgtcgtaccttatttcatacatttttttttctatgtgtaacaaagaaaacatgatataatacacacctgatatacatatataccaagtgttcattaaaatgaaaatatgaagttgtttaatgtcttcaatccattccgggaggtaatggttcagattgaggagggggcatcgtaacgatgggctgctcttctaccatcaccacatcaggctgcggtaaaataacggggggcggcaccatcgctacaggagggggcacagtaactgatcctaaaacaacttcttggacggcttggggaatatgggagcgctgagcttcagtaaaagtcaataaatgttctcgaagtggcccttgcaagtcagcacatattgtcaacgcttcctctaattgctgagggggtaactgcattagaacagcaaaactttgaggtttggttctctgacagcatttgacgaatccttcccataccactttttgtttccatacctttttcaaaataagtctctgtaaaatattcattatgaatccagagagccttggataagtacctaaagcttgaattacagtcctcatgaggagggttggtagaggtgattgatccatcaattgttgcaggacaacagccaaaacttcttgagtaaacacctgtctctcctgtaggcacatagatgtcgccttgataacagtcttcaagtctgccttggtggagtctatgagatgcagcgaaaccaataattcagtagggctgattggactatctccgtgcagccccagaagcctgttgaaaacttctcgcacaactacaggattcaattttatgagtttgggtaaagctgatattatctcttgtttagatagaccgttgagcacagggataaggaacctgacatcggaaattctgctgttgtacaaatctcgtactctgttgacgagatcaggggtcggattagctttgtcagtcaaaatgtgtatcactcttgtaactaaagtttcagagccctttggacactcttcaaccagcttcagtaattccgcagaactcattcccattgtttttatgggcacttctatgagccttagtattatccgtttgatatcagcacttgtttgtacataaacctttgccaaatcatgaatgagactttcattaacgggcagcaacgacacataagggagtaaacacgctttgatgaaatcatctccccaactctcacttttcaaccgtccttgattgatcccacacaagctttctggtggtttgggcagtttcaggaattccatattcatcctagcaaactcctcaataaccaatctcaagtcgaatcttttgtggagttccagaacgtgtccaatagcggaatctcgtacagcattggactcgtatgtagtgtatgacagaagagcattgaggaagaccaactgcttcggaggttttctcacggtcaagtcacgcagcagtccaagagcccagcctgaccgtctctcatctctgcacacagctcttacttcttccagggcatcatcagttatggaaggggcttcgagcagtagcctcgataaaatcagggcatctgttgcagatacattaatgaagctgcatagaaggaaattataactatcatctagtttcacgtctcttctaagaggtggtattctggaaaatccctgcataatgctgtattcttcaaagagccaagacagagcaatatcgacgtatgacctgagatcattaagaaggaatttcaaaactgtgtctcgtacacctaaattgaaacaagtggccatagttgtgataatcttctgatgcagttgtttattagcagatctatgaggagtcaggagtctttctacagctttcagcatcagtctttctttcacatctttttccagaggttttgttatttccgcaagtttcagagtcttgattctcagtactttaactttttctttcttgggcggtggcttttctctctcatctttattatcttcagattctcttgacctttttttgctttgttccaggcttttcaatttttccgcaatttttttaccagggccaacatttgcctgagtgaattgctttgccaacacatttgccaaatgtattttaccaatatttcccaggttgacaaactcagcatagtccttgataaagtctgtgggcacagtattaggcagtttaggaatattggtgaaaatgagataaactgctttttcaagagtgagattttctaaaatgaactgttcgtttgcttctaaaggtgtcagttgagaatctgtggactcgtcaatgtcaaatgagttatgatctagacgtgctctctttacactcttttgaaccagcgattccgaagatagagttcgctttttgtactttttcctttcatcagatttaggaatcaacttatttatttcagactgggaacaccccaactctgataatatgggagagatttggtctacatattcataggctgcggggtgtttcaaaagactgcacagctctgttttcagtttctttttcacagagctcacttgtgtagttgtcaaagtggggggtaagttattaaacaaagattcaagagcattcactactctaaccatgaattcagccctacttttagctatattcgtaagtgcacctatacaagctaacaagtttgcactactaatatgaggagatccatggaatttcactaatacttcaaacaaattacttgcttcctcttctaaatgtcttcgtcgagcaacttttagtgttaaaggtacatcatccagtgaaaaatcattgggacgtctgctctcagtttcatcaggatatgtttgaagaagtacaacacactcaagaaactttactgaactagtccttataccatcattatcactatctatcatattggcgatttccaacttgatagcactcaattgcttccaggcttcctccatttcatcggtagtgatcgaggccatgcaaagccatgacaaagttcggcgataaattgtgattgcagcttgtattacacgtttctgaaccgctacagattcatcacaaagcagcatatgtaaatgaagcataacctttggtatgtaagattcacgaactttaatcaattcttcgatgaaaccaactaaggcttttttaatatccggatttctttctgttgtaaaattcaaaatattctgtagaaattttggcagtaatattggggttttcctcagtaaaatttcttgaattttgaagaaataagagactttctcggaagcttcttgtgcaagagcacaacaattaagatactgtgtgacctgttcatcatcagaaatattatcaacaaattccattttattcaatctcctgtataacaataacctatttcaatacaaatgccaagcagtaaccaaaattgattcctgatatgaaaaatattacatcctatgattgttgtgaaaagctatatgaagaataatttaaaacaatcaggagaaaatatcaataatcaatatggaaaaattcataaccaagaatattagtgacaaaaccaccgacataagttacgtctattgacaaaacggacaaaat

SEQ ID NO: 607 - DNA, 2265 bp, Leptinotarsa decemlineata
  Annotation=Exosome complex exonuclease RRP45, putative; Tribolium gene name from OrthoDB database=TC007574; Blast E- value Tribolium Gene vs. Leptinotarsa Unigene=3E-151
gaggaagttagtagatactgtattttttttaatttttcatcacacattgtttattgtttgaatgatagaaatacactaattggccagattgaaagcgaaagccaaaaacattaggatgaattataattgaagtggatagttagcgagcccaataaaacaaagaggaaaggaatcatcacttgttagttcgacatgtctgtgaggaaaacaacaatttcaaattgtgaaaaaaaaatttctacttaaaaatctatcagaagggaataggctagatggcagaaccttcaatgaattcagaaaagttaacctagaatttggcaaggattgggggtgctgttatgtttctttagggaaaactaaagttttagctcaagtttcttgtgaaattcaacagccaaagtcatctagacctagtgaaggcattctaatcataaacattgaacttaacccactagctgatccaaattttgaagctggtagatcttcggatttgtctgttcagttgaaccgtctcttggaaaaatgtttgaaagattccaaagccgtagacttggagtcactgtgcatcaaaatgaatgaaaaggtttgggtcattcgggtggatataaatgttctgaatcatgaaggaaacattctcgactgtgcttcaatagcagcacttgcagcattaacacattttcgtaggcctgatgttacctgtgatggggaagaattcacaattcatagtctcaagcaacgagatcctatacctactgtcattcaccactatcctgtttgtgttacatattctatattcagtggaggagagtttatattggctgatccaactttgctggaagagggagtggctgatgggtttttgtcaattgggctgaatgcttacaaagaattatgtggactccatttgattggcaaagcggctttgaatcttgatgttattatgagtacagcagaaaaagctgctggtagggcatctaatattgtacagcaaatcaaggagtctgttcaagcagacaatgaaaaaaggttagaaaaaaaagatacaggcttccataaaactgtcttggaagaaattgaaaaacctttggaggatttgagtctatacctaaaccagtggagctcaaacaaaggaaagaagaaaaaaaagaaaaataaagataaacgtaaagaaaaagaatacattgaagaaactaaggattctattgctgaaattgaagttttagggagtggtacggcagctttagttcctaatgactcagaaagcaattcgaaatgggaagcatgccaaagtgaagatgaggatgaagttatggtggtggaaattccagctcctgttgtcgaaactgtggatattgcaaatacagacagcgaagaggaagctgttgtgattttaaatgctgattcaaaaactaagaagaaaaagaagaagctgaaaaataaaacatctccaaaaataaatttcagttgtatcattgcaattttttattttatgaaaaaatcaaacatgaaaaatgtaaaatatgtattctaataaaagaataaagtaggcaaagaaattaattgcccttgctaatttgtgtcattattgatgccgtttttctggtccaacttgttggcatttgttttcacagtgtagataaagaacgtcaaaacttctttttctttcactggaatagttttgaagtgcttcataagagtatcagccaattgtgctttattcagtccttgtctcattggaaccttatagtgcctcttgtaccttctcaaagtattgacttggagttggtagagatcaacttctggaacatccgtgtctgtctcgtttgagtcatcctcagagtcttttcgtcgccttttgtttctggcacactgaatgatcattttgtggtaatcacagatataattgtgtcttgcgttattgtctattcctaaattcaatcgcctttgcgttaccgttttctgaattcgtttgctgtatgatgcgtttccagctggttttgaacaacgatcgccgttttcaatcaagcaacaaatttgatcactagggtcccttgaatcctcttcaccggtactgaaaccgttcatttgtgattccactatgttaaacgatttcaataattagttgttgtcactacattttcctctttattgcctttgtgcataaaacccttgtacccgcggtactgtttacttgttttcattaactctaaacttaaacataaacttcttacaccttactacgtatttttgttatgactaatgacc

SEQ ID NO: 608 - DNA, 1255 bp, Leptinotarsa decemlineata
  Annotation=Neuroendocrine protein 7b2; Tribolium gene name from OrthoDB database=TC008457; Blast E-value Tribolium Gene vs. Leptinotarsa Unigene=2E-82
ttgttataccaccccttcagtctggattgattttgactccgtgaggatgagaagttgaaaatctacttaaattatgttctgatttcagttcaggtccatgaatttgatggtgaatggggaaatgagctgaaatcaatagggcctaaaacatgattcaagttgataattttggccacctcctccgtgatacgtcaaaagggtcgctttgattagacttcatcattcttatgagaattgcgtacttgggattgtagttcacctaactctaacagtatgggtaccttttatatcatgaagacacatttgtacggaaagcaactactatctagatttatttgaaacacatttgttgtacacgggtgaggacttgagttgattattattattcttcgaaggatcaccttgttcatagccatagtcgagagttttttcttgtgtagtggttgggaccgcctgtcctttgttttgttcaaggtttttacatgacattgtttccttttttggctgccactggaagtttttcgccagttaggaatgggttgatcttcttactcttcatcagagcattgaatccaaaattgtctatcatatccatattatcgtcgtcatcgatattattagaattgggacagtcaaacatatgttccgtgtcgcacatacaatcttgagatgcttgatatctgcgactgaaactggcggaattttcgaattcttctatgcatccttgttcttctgtgtatcctacagggcagggattgggagggttacaataagccggcagagtggaatctgttttgacttcctgtttattttgcattccttccggtcggagtaattgattcccctctccagccccgccagagatgaactgttttccccaaatactgctgtgctgcagatattcttgatctcttatactggggtgtatgttgaaactccccacagcatcatagtctaaaggaaacataggctcttcctccagaccgccattcactgatctcgattccatagacaatccatcagtgaaatcaaggtatgacactccatcaccttcagaaattcctttgccatttatgcgattcacgagatcgcgtagaaaatatccagagagaaaattgttctttactgctggtaaataaccgaatgctccagtaacagacagaaccaaaagtagtatctccatgacttttggaatatttcgaccccaagggtcgaacagtaaatgcgaaggacaacaaggattcctctggatgaa

SEQ ID NO: 609 - DNA, 2062 bp, Leptinotarsa decemlineata
  Annotation=Putative uncharacterized protein; Tribolium gene name from OrthoDB database=TC011917; Blast E-value Tribolium Gene vs. Leptinotarsa Unigene=3E-159
gagtcaatttcgaattgttgttttgtacgttgatgttgatctgcctgcagctagatttttttttcgtaaaattgccgaatatgttttaaatgtcaggtgattttttttcaaaacgtaaatgatcggttacagttatatgcgggatacatgtttattattcgatgtgaaaagaataacccatcgtgcatattttggccaaaatacttgaagagatatgtgaatcaatcaaataatttcgatgtaaaatttgaaatatcagtcgtttccaaatgagaacaaagaattttttgcttacgttgggaggcgtactgagtttgagcttaatttttgtcatttttggtcaagagaagactgaatacatagtgacaactacaaataaacaaattcggactttcaaggataatctgctcgacgcagaaacaaaaacgctaaatgcggatgagaagtacttgcacattttgggcttcgtggagaggccaagactttttccgaatgatgtctggaggaatacttctctgcctgtcatcgttacttatgtgagagacggactggagagccaagcgatagggctcataatcaatgtggcaaaaatcataccaaataataccattttagtttacaatttaggattaagtgaccaaggatacaaaacgctcacaaattactgcaacagcacaagatgccaagtgataactttcgacttatcgttattcccgtctcacgttaacgaagtgatccatgcttatcgaccacttattatacaggacgcgctccaccacaccggagccatcttcttcctggaatcgaactaccgactgctgaggaacatctcgcagaacgtgctcgccagactgtacgacgatcgagccaaagagacgggcgtcctcgccctgcccttcgacctgaagaaccccgtctcgagcctgacccacaagaagatgttcgagtacttccgaacggacgccgagaactttctgtttctgcagatggtcaaggcggacgttctgctcctcgtcaacaccgagcgggtgcatcggagcgtgatgctgccttgggtgcagtgtgccctcacgcaggattgcatcatgccgatcggggcccagtcggctggctgcaggtttgacaagaaaccacagtacaggtactcaggttgtcacagctacgacacatcagcactgaacatagtcctgggactgactttcaggcagaacaccagtcagtacacttacagcgactccgtgaatttcttcgaaacagtaccccccgacaaagctgcggccatgttgagggagctcgaacaaaattctacggcggaagcgcggaccgtatccaatgaatgaagttgacttcattgcggaaagttctcgatcgaaccattttcattgctcaaaatttctggctctgcttgcgccaagatgagtttcaatgttacgatggtttattcattattcagatcaatttttcacggtaactcgttggtgtggatgacggaggttgggggtcccatggaggaaccttgaggtacttctttttcggtttcttagatgcttagaggcttcgggtgagattttcagaagttatccagtaaaataacggaggttctcgtgtctgaagtatttttttggaagatgtaacgaaaagattcgctacattctgtttgtactgtttataaaatacagggcgtcgatgttgactgtgtcatttttaggccatctttatttaaaaatctacggtgttgatattatacaaatagaatacaaaattttcttgggtattgaagagattgacaaatcgggatctactttgaaacattatacattttctattatatttatacaattttaattattttatttaaaccatatacatcaagcttgaactgtgatataaggctcatcataaatgaatttataacattttttattaattccttgtacatttttcatattatttttcagtttagatacattttatatttatattacgaaaaaaaagttttatctgacatcgtttacacgaaagtggattcgatgtcattcgattttcgttggagttactctgt

SEQ ID NO: 610 - DNA, 2613 bp, Leptinotarsa decemlineata
  Annotation=PIH1 domain-containing protein 1; Tribolium gene name from OrthoDB database=TC012786; Blast E-value Tribolium Gene vs. Leptinotarsa Unigene=0
aatattgatgtttttattcatcaacttttttgctaacaattaaaaataatcatccgctatacctatcctagtactacattaccaaacaaaaaccttttaaaaaagtcaaaccactgcctatttgtagtttccttactttaacaatctttacaatactcaccaaaataaacaaaatagcaaatttgcaatttgccaattctatatattcgaaaacacaatcagttatactgataacaatattgtatcgatatgaaaatgatacaaaaaaatatattcaactgattgatgtactacattagaacatttcaatcaaattcagtgtgaatagccatctccttcaaaatgaaaaatatcattgtcggatttgttactttcttcatggcgtgaatcactacttatcttgtcaacagaatgaaacttgtcgaaatcttcttccttcttttcatcacctgaagcttcactttcactatgccgacgttctagagcacgtttcttattctttgccttcctctgatttttctttttctgacccaaaatgctagaattcgacctgaacagttgttgcgtaactacatcattgaatctgactgttttcttcaggctaccagaaatttccccatcttcaggtataaccgagtctaggctagcatgacaattttcaaaagaagagcagacaaaatcatccaaactagactcggatatgcttcgactaactgtgaatcgattggatgatagtctcttcagaattcctttatttttgcttgggctaaagctaccatagcacagctcatctccactggactcataggaatcaccgagaatatcaatagccctggtttttttatcacatttagtgtcgtaaaaactgctttgtgagtttggatgattcacgggttcaggttctaccgaaggtgtttctgaatgagtttccaactgtttattactcttttcctcagtttcttctcctaacagtatagtattgatgatttggggctcctccacatgtttttctgttaaattatcttcattcaccccaaaaaaatattcagttaatgtttcacagtgagaaacaggtacttgaagtataacgttgttgtcccatacttccactgtggtattttcagcatcaattttggaactgggcaattttacacaaaaagcatagtgactgggataaaaactagaacctatactggtgaattttgtatgaactatggtgccattctcaccgaatattttggaaaccgaattttcatctacattttttacattcagtgtaaacgctataatattttcaaaaacatggcatgtaaattcaggtatattgtaatgcaaattttcatcaagaaattttgtcctaaattcgctagatttttcaacacagttttcacttgaaggcaattcagtaactaactttttatcactggtctcatcatcagattccgggattcccggggaacattgatcactttcaacaccactatcactaaagtcgaaacaggttcgggattgcctaacaggtagagttattactaactttctcaaatccttatcaaacttggcattgccagatgcttcattgacatgatagggtaatgttaaattcaatttgtactttgctggggattcactaacaacttgcacggttttttctgtaacatctaatgttatatcagcagaagatttgagcagaggcaaatttatttccactatcaactcttttggtataactgcatttaattttgcttccctgttttctgtaaattcttgaatgtcaacatgactcctgtgttttatggtataatttggtgtggtatagttggatttttcatccaagctatttcttctatatacttttttacacttttttgggctaattttatcagattccactttttcaaaaattttatcataaaactctttttcttctggagtttgtttgggtttgttttctgatggagatctaataacacttgcatgaggtattcccttgtaattgagtttgggaaatttcaaatttttcttatccaattgaaaatcaaaatttgtttctatagcttccaaggcagtgttattgaccatatcacgaaatgttttatttttagatgctaaatgaagagtatctgaatgaaacactatgtcaaaaacccgacaaggaactttcttattatctaaatcttctcgtggaggtgataatgaatgaggtagggaccacgtcaatcctttctctccttctctgattgtcggtgaagacgtaggtttttttatatgatcattcgcacaaatattgataaaagctttttggttaccattaacactggtttttattacataacctggtcggggatgaataaaagtaatatcgttaccacgttctttctccagttgagtgatctcctgctcataaagtattttgttttttggatcctgtagttcttcaacatagtctgtcagtagttttctgaattcaggcttttttaatgcttccccaatacaattaacttcctcacttgtaagatcaagttctttcagtttattgaacgaattatccatacttgcttcaattggaagtaagagataaaaatgtaaacatggaacgtagcaacgaacagt

SEQ ID NO: 611 - DNA, 2857 bp, Leptinotarsa decemlineata
  Annotation=Calcium-binding mitochondrial carrier protein SCaMC- 2; Tribolium gene name from OrthoDB database=TC005667; Blast E- value Tribolium Gene vs. Leptinotarsa Unigene=1E-95
gagtacatgtcatcatacctatctcatgatagtagttgatatcgttcaattaaaactattagaatcagctgatagttacagatttgaggattctgggacaggaataacaggaattaataaaatgtcgataattgttgtagaaaataaagatgaagttatatcgaaattatgtgaactaattgaagaagtcgcagagaaaagtattcaaacaaacggaatattttccgttggcgtttctggtgggtctctagccgaatttctatccaaaggccttccaagtataaagtcggattttactaaatggagaatatttttctgcgatgagagacttgttccagtagatgacgctgaatctacttttggtctatacaaaagaactttgattgattctggagccgttaacctcaaacctgaacaatttgttcaaataaaacaaggtgtatcagctgatgaagcagccactgattatgtcgaacaaatatccagttactttaagaccggtgaagttcctattttcgacatgttattattaggaatggggccagacggccatacctgttctctctttcctggtcacaaactcctaactgaagaacacaaatgggtggcttctataacagattcgcctaagccacccccatgcaggatcacactaacctaccctgttatcaataatgctaggttctgtatttttgctgcagcaggtgcaggaaaggcagctatgataaagagaatattagtagataaggaggatcttccggcagccagagtgaaaccaacaactggaaaattatactggatagtggacaaagaagcaggattatatgtgaacaaaatatgaacagatagtcttaacattttaatcaggggaatttttttataaatacatatacagtataataaataccatatttattaaaatattaagtacatcacatttcccatttattttatttggaatataatatatatctgtaaatatatatcctgggattcatctatgtaatatgtttgaatgtcaatctggaaataattcatgcaaacttttaaggattcaaaagtggcataacatcaataacgagtggataattttaaaatctagtgagttttaaaagcgaatttgaaaatgcaaataaataagaaatttccgtttgtggctgaagtcatgtagttgaaagagtataactagccttcatacccatcatggattagacattgcaactatcacatgaattaagcacagaagtttgttgtaatgcatttattttatcttgcccagccacaaacgtatcaacacatttggaggagtaggagaaatatatccagcgtatgttgaagcttattatgtacaaataaataaatttaaactagacaatattaaattgtcatgtagaaagattcgctccgccaagtcgaagccatgctgccctccgcagaattttggaaaataaataaattggttcctaagctgtcttcataacatcacgtcatgttgaccccaaggagtcgactggaatattcatagacaacataactgatactgacagctggcattacttttataaagttgggggtgattcctcgatagagtccaaagaaaccttctttctcaataatggtgcggaatacgcctgtcattgtggccgaagatgggtctatggaaggatgaacaacttgtgcttgtaatctggtcctaatgagagctaagggataggaacacatctggcctagtgtactgctagcgctgccgcaagccaaaagcatccaaaaacttggttgttcattacttaagtgtgtcatgaagtatttcttctttaaagtttcatatacagctaaatctatccccgcgtatggtataatacctaatatatttggaatgtaacctctgtaaaaactcatcaatccttctccgacatatatcttgtaggcagcgtcagctatacttttatactgcccggtttttctcagagcaagcctggtcttgagtacctccaatggataaatggcgctttggctgattcctcctgctagtgcaccagcaatgaacctttcataaatgcttagagtattagttgagtctcccttgatcagtcttttgatttgttcataggcggcaaatttaagagctgactcgggtgctatcttgagaacgttgattccgtttcctctccaaagaccagtaacaccaccttctttcaccatgtgattgaaacaatcactaattttctgtttggaaggttgtacctgtaaaaacacttttaatcgatctaaaggtgctgtacatgttctcgaaacggctccagctacgccaccagcagccaaatgtctccaccactttccagtttgcatttcattttgtgtgaagtcatctggtacattcatatcctccccgatatccaagtacttcatcagttccttgaaaatgtaaacgaaatcatccaaaacatccggaaggctacccggagattcttcgaaagacatttttgcagatatgacgaattatccggtcgtagtaaaaaaatgaaatcgaattactagtatcacagtttccacttggcgctcgaaaactttcggccggtcttccgcgactttgcacccgacacagtcagctgttcctagagatgaatgagtcacgactactgaacgctgctaatatagctgccgactgaacttcgagctatcacagttagacgtggaataacaatgtaacgttaccgagttaatgataaggataacttaactagataaccgacgccgaccggttcatgatcgacgagatctaggaagtacggagtggggaaactccgagcctctacacctacgaccgataccgacaaggactgaaaaccgaaagacc

SEQ ID NO: 612 - DNA, 1161 bp, Leptinotarsa decemlineata
  Annotation=Methyltransferase-like protein 9; Tribolium gene name from OrthoDB database=TC003894; Blast E-value Tribolium Gene vs. Leptinotarsa Unigene=1E-133
aatggttaattcatatgtatatataatgcattaacatagttgtgtttcaagatttagtgttagtcatcctctgatgatgctaacatggttagcgaaacgcctcttgagagacagttcgtcactttcggtgtggagaaagtgttttcaatagacttgtagattttgttagctttgaaaaaaataggacaaagaatttgaaatactctttatttttcatccacatttcgaatctagttacaaaaaagtttctaatgtttttattcactacattttgaaaagattgaaatatataattcaatcagtatgcctcttcttgagtacaaagatggaatcgtctagccaatagtatgactgctgcaaatctccttcacataagtaaggtaccctactccaagaaactatttcaaaattagcaggttctaatacgttcttcactatgctctccacttgcttttcgaaactggaaccctttatctgtagtgattctttaggtttgtgatcaggagatgattctacgtagacagaaaatggtaacacaatggccatgagtacccttccatctgtagccagagaaccaccaatttgatccaacatttttagaggttcatcacatcgatctagcaggttcagacatgaaataacatcaaattttttgtcgatataccaattgtctacgtccaatacttcatacccttgtttttgtagcaaacttttcattgtcggagacacatcagtggcgtaagtttttttgaaaagcggtgccatgtgggcagtcactcctccgtcacctgctcccaaatctagaagggaccccgagctccatgtttcttctactcttaatatttttctaaaatgggattgggacaatacgaacattgaaccacgttgaagccagccattaatcgatgtttgagtcataaaccaacccaaaaacagttttgcgagggaatgccacatttgtgttaaaatccagtccgatttcttttctgactcttccagaaaatccagggtgtcttggtctgggtcaagttgaacgaatttcgaagcgagggaagagggtacttcactcagatcgcattgataccacttccgtttgtcgaagttgctgagaaagtcgtcatgttgttgttttcgatacagggctcgcgcgagtgagcccct

SEQ ID NO: 613 - DNA, 5620 bp, Leptinotarsa decemlineata
  Annotation=SPRY domain-containing SOCS box protein; Tribolium gene name from OrthoDB database=TC005709; Blast E-value Tribolium Gene vs. Leptinotarsa Unigene=8E-17; Blast E-value Tribolium Gene vs. Leptinotarsa Unigene=0
cggcgaagggttcgtggaatgagcatgggccagaaggtttcaggaggagtcaaggccgttaatagagatgccgccgccccctataaaccggtcattcccagagaattggcgcaggattttgcccgccctcctcggctcgatatgttactcgacatgccaccagcactcagggagacgcaattgaagtatagttggaaccaggacgaccgctctctcaacatatttgtcaaagaagatgacaaacttacgtttcacaggcacccggtggcccaaagtacagactgcattagaggaaaagtgggtctcacgaaaggaatgcattgttgggaagtgtgttggtcgacaaggcagagaggtacgcatgccgtagtaggcgtagctacagcagaggcacctcttcattctgtcggctaccaaagtttagtggggagtacagatacgtcatggggatgggatttaggtcgtaataaattgtaccacgattcgaagaactctcctggggtaacttatccagcgttactaaaacctgacgagactttcatagtgccagataaattcctagtggtgctggatatggacgaaggtacgcttagtttcgtagtggatggccagtacttaggagtcgcgttcaggggactcaaaggaaggaagttgtatccgatagttagtgctgtttggggacattgtgaaataactatgagatatattggaggactggatcctgaacctctacctcttatggacctgtgccgacgcgtgattcggcagcgcctaggaaagcagcatttagaagagaaggtgatgagtttgcaattgccacaagccttacaaacgtacctcctgtacagagaccgaagataatacatcagactgtttagtgcagtgaagtgtttttcaatgactgctaacttgtaggaatgtaatgaagtaaccaaataatcgaactatgcccgaagaaggtaacgcgggacgcgtttggacgtggaaaaagcgagtctttttcgccgatgtgatggtacgtgaatctcggggttggtgagcgcgccatctactggtgtatctccggacaagcgcgctcagtccttgtctttcgttgagaacattgccatatggtgtatatagttgtaacctaacaagtcttcggaaaaatatattctcaagcacagcttccttcgaaataaagctttacaatatttttttttgacaagtgtaccacatgagtgctagactgttttgttgtattatatattttgtaaatatgttattttttctattttgttccctttttttttcgacagctgcaggaatacattgaaatatcgagctggacggcagtggtggatccaagatcgttgaaggtttttcttcgtgcgttgaaaaattgatattcgaatgtaagattattggaaacggagtcgaaggctctccaagctctcttggtctcttttctctttctctctctcattccgctgccggcattaggaagtaatccagattgattttttccagattcctgtagtttccgctttagctcacttgggaagagtttttattctcgattggtagtatgaggtgattcgttattctgttggccatgactcaattggggtttttgactattctggaccgttttaaaagatttccaaagcatagcgaacagattagtggtttgaaccttgtgaaaattatggattatagtaaataagaccttgaaagcgggtagaatttacttcgttgggaaatctttatagtatgtttcaaacgcaaggttttttttatcagtagtttcaaaatcttgaaaggaattttgataagacaccctttacaaactggcaccgaatcatatttgatttaatcacatcttccacttggttgatttttaataatttcaaattagtttttttctttggcgatggaaatcagtaatactattcatgataataattgaagttatcacagaagaaatacagttttttttcgttttaatttggagaaaaaaatattattttgcattcgaccttaatttaatttatgaaaatttatttttgtgaagttcttaatgttggttaagtttttgaggtgagaaaaccataagtcaaattgaatgtactcagcaatgtttcggtgaaaaatttgatgtttggactctcaatgtctgaaagtgtaaattttaaatttgtgaaaaaaataaatattgaatataccatagtcgaattatagtgatgagtgagtttcggagaagagaaattattataaatatatttatgaaaatgctagataatggaaatgcgaaaaataatcttaccaagctatttcatgattaaatgttgctgttgttggtatcacagacattcaataattcaaattttatttccggtcattataacttacttttttcacagattatcattttcatactcttaaattttgtatccattaattatttcttctcatttttttatattatttcctttattcattcaacttatctgaataattcggtcgtgatattttcaatatataattaattttttttcccacagatttcgattctgtcatcctggaaatcctagtctccaacattcatattatttgatttaggaacgtttgtttttgaatattgaactttttattagttttgagataattttttttattatgtatattataaaaagcaagtgattttccttgctttcgtacataacttcaaaaaacttacaagcatattgtcatagttaaacaaaattttacaatctataaaccttttgaagtatcccatggaataaattgcaggtttgactttcttgagcttttgtttgataacactcaaattgactcgatttataggcaccagctctcaagggcttcccttttctcaaataatcctcataaagattatccgcttctgaaataattgtcatacattcaattttatctacatcactttttttgctattgcagggcaatctggcaaccgatcattggtaaaaacgtatctctgtctctctctctctgttataatacagttcagcagtgttgttgccagattcagtaaatatttgtggaaataacaaaactgtgacatcaaaaccttctgcttataaataattcaatgaaataagttctcgtgggatggttttttcatgtaagacagaatttgtcgaatcttttttttttggaaaaatggaatcttcaaagacatgaacttgaacaaatgaatttcatatcaagaatattgtcagtctaattgcaaacatgaaaggtatgaaatttcagtctcttaataattagttttactgaatatccatcatctcctttccttatagtttgaaaaattgtttttttttgttgagcctaacgtcattaatttgtacatatttttcaatttgtttttttaacagaggcaagttttccaaatctttttttcactgtaggaaatgcaattattcatagataaaaagtattttcatcaagcagagaccagtatgattcgagaatgtcagaatgaacttgataacagtctgaagggttttcaacatgaaaaagtatcattgaaacgttttcaagattttgaaatgttgataaaaatctttctcggtgccccaaaaaggagatgtcatggaaaattcgatacttttaccagaaatttctctctaatacttcctgttaagatttatctgttcatggaggttacttctgagggttactataatgttagtacctctcccttttttgatggtgatgaagcattgattgaaatttgtttcaagtgtagaggttgttgcagtgatgagcttacaacagaatatcaagtgtcgtcgagtatagaatctcgtaatattagggaaaactcgttgaaatttcagttatttattcattttgatgagtttttcacattgtttttaatcgtactattttattctgaaacaattacttcaacattggattgcttcatcaatatctcatgtaattttatttgctcccactttgaaaaatgttgctaattttgaccccaagtgttttgaaacgtgggcatatagcatgtaatatataggttaagttgaatgagacaacaggctcctcgcggcaaacctccataatttcgcaaattgtgaatcaacattgaatctaagatgtttcacatatttttgtctaaaatatgcaaacgacttaaatgtattggtttttctattcacgtaccttgaacatattatttatagcaaatagttgaagcatatacattaatataaaaaaagctgaaactgcaaaggtatcagttcatttggtttcttcaagatctaaagcactctatttctcagttcttttttttaaatgcataaccatttgcataggcaacagatattaggtaatactgcacccatctttgtaatcactagttgcttatgaaaatgattatgattcattttcaaaatatccgagtttctttttggtgtatgaaacaatttaactagcaggattctagaacattaccttgaggaacctcgcattcattacgtctgtaactcaattttgactatgctttttgtattatttttttattagaatgttttatttatttttgaatcatttaagaatactgcaccattatttgcttaggcaactaatattttataaccagtttttgtaatcactagttgcctgagcaagtggttatgcattttcatctcaagagtgtcacttcaatgtaagggtaacaatatggagagattgatgagacaaatgctctggaatcagaaattattagagtagctaatcagaaatccaatttaacaggaccaagaagcaacttggtggcaatgttgaattcaatttttttgtttcaaaatgagtcgagggatgcacgaggaccttaaatgtcttaatttctactcgccttgtttgcattttatgaatgtagagagatgcttataagtccagataatattgaaaaggtgaccaagaccttatcattctaagattaatgacttatattcttgaattgatttttcgacgtgttcgccagttccaatttttgtcttcgaggtgagacaatacgactgctccgttttgttgagattgaaatattttttaagatttacgtagaattgtctttattatatatagaatgttcgtattttggccattcaatggctgtttgtgaatatggagtatgtatgtgactgtggtattgtgttagttttagaaatttttttgataacgtttgtcttttttgcataaaaagtgttcattaggtaaaaaaaattattcgcgtattttgtattgagcggcaaatataaaaatgaagatatgtacggtttctcctaagtaaaatgattgcttccaagatgtccttttactcattggattgattctgtgaggtgtttattgattgtaggtgatgttccgaaccaattcttttactgagaccaaaggatagattttctttgttaatgttagtttatgtatctgatttggatcctcaactcggtggttggttttgacagacagatattagaccaccagacttgtgtagagtttttgaaatgcaattcgtagaggcctgggcaattattgataagtaggatgtttaactgtatttctgattttgctgtgaaagacc

SEQ ID NO: 614 - DNA, 1539 bp, Leptinotarsa decemlineata
  Annotation=DEAD box ATP-dependent RNA helicase; Tribolium gene name from OrthoDB database=TC014113; Blast E-value Tribolium Gene vs. Leptinotarsa Unigene=0
tcagctttatacctgtctcacaggaatttaagcttatgtgctagtgtctggaataagacttagttttcatatgttgtgaattgtgaactatcattttgtgggaattgaagtcaaaacgaataggcatttttaaactcacatatcagttactgctataaacgaaaaatggctggtgctactaaaagggcagcttcagtttttgaagacctctctaatgtggaattcgagacaagtgaagatgtggaagttatcgacaagttcaagaatatgaatcttaaagaagaactcctcaggggaatttttgcatatggatttgataagccatctgctattcagcagagagctataaagccaattatgaaaggaagagacgtgattgcacaggctcagtctggtactggtaaaactgcgacgttttcaatctccattctacaatctctagatcttacaatgagagaaactcaagttttatgcttgtccccaactagggaattggcagttcaaattcaaaaagtaattctagctttaggagattttatgaatgttcaatgtcatgcttgtattggtggcacaaatttaggagaagacataagaaaactagattacggacaacatgtcgtcagtggaacaccaggaagagtgtatgatatgattcgtagacgagcactacgaactagatctgtgaaaatgttggtattagatgaagctgatgaaatgttgaacaaaggattcaaagaacaaatttatgatgtttatcgatttcttccaccctctacacaggttgttttgatatctgcaactttacctcatgaaattttggagataacttctaaatttatgacagatccaattcgtatactggtaaaacgtgatgaattgactctggaaggtatcaaacagttcttcgtagctgtggaacgtgaagagtggaaatttgacactctctgtgacctttatgatactcttactataactcaagctgttatattctgtaatacaaaaaggaaggtggactggctgacagaaaaaatgagagaaaacaacttcactgtgagcgccatgcatggagatatgccccaaaaggagagggacaacatcatgaaggagttcaggtcaggacagagcagagttcttattaccaccgatgtttgggcccgaggaatagacgttcagcaagttagtttggtaataaactatgatttaccaaataatcgtgaattgtacattcatcgtattggtagatctgggcgttttggacgtaagggtgttgcaatcaattttgtcaagtccgatgacattagaattttgagagatattgaacagtattattcaacacaaattgatgaaatgcccatgaatgttgctgatttgatataaaaaattttgtattgtattgttggacaaaattctatatcattttaccaaatatgaacgaataaaggattaatttattttcctataccttaagatacattagaaaaaaattatggttgaataggtatatatgtttttttataaaataaagattattgaaaattg

SEQ ID NO: 615 - DNA, 1342 bp, Leptinotarsa decemlineata
  Annotation=Engulfment and cell motility protein 1; Tribolium gene name from OrthoDB database=TC002742; Blast E-value Tribolium Gene vs. Leptinotarsa Unigene=0
ggttttgaacatgtccaaataaatcataaaaatgtgtattttttctgatataactgatcagctgagaattatttaatttctcgtgttgaggaataaaataatgccagccatgaaggacgccagtattgtaaaaattgcggttgaaatgactgatcaggtaccacaactgatagaattcaatcaaaagcaacccttggcaggcataatacaagaactatgcaatggatggaatctcacggatccggaacaatatgccttacagttcaatgaaaacaataatagcaattatattactgaaaaaaatagaaatgaaataaaaaacggatctgtcttacgtttacagaattcaccttctaaaacagctcaagatattctcaacaaactgaacacgggaagttctgaagataaaactaatgctatgagtaaactttctactctcagtgctgatatgacttttgctcttgatttcataaataaacaaggcttaaccctaattattaaacaaattgaaggaggaaaatgtaaaagtaccgtacttgcacatacccttctttcttttgtggaattgatggagcatggtattgtttcttgggatatcttaaatggagaattcatttctagagtagcaggttttgtgaacacaccgcaggaagcacagatcactcaggcagcactttcaattttagaaaacgtggttctcaacagtacagagggttacggacaggtcgagcgagaggtacccataggctcgctagtggtccatcttcaagctgcaccagttgtgcagcagaatgctgttgcactgataaatgctttactttcaagagctgattctattaaaagaagaactttggtagctactctcacatcgaaacaagttagaactatgattcaaaataatattctacaaactggggctgccaaaggagccgaaatggcacatcagctatatgttttgcagactttgatgttgggactcttggaacaaagaatgatgacaaaaatggatcctcaggatcaagatggccatgacaaaattaaggagctcagacgaattgctttcgataatgaaggtgctggtagtacaagaggcccgggtggctttacaagggattacaagaagcttggtttcaaaaatgatataaatcctgctctggacttcactgaaaccccgccgggtcttttagctctagattgcatgatttattttgctcgcaatcatcctgagaattatactaaacttgttttggagaacagttgtagggcagatgaacatgaatgtccttttggaagagcgagtgttgaactggtgaggatcttgtgtgaattgctaaaaattggt

SEQ ID NO: 616 - DNA, 1375 bp, Leptinotarsa decemlineata
  Annotation=Peroxisomal biogenesis factor, putative; Tribolium gene name from OrthoDB database=TC002842; Blast E-value Tribolium Gene vs. Leptinotarsa Unigene=5E-126
gtgacgtcgctgattctatggcttcaaagttcaaaacaatgatagaaatagaatgtcaattttttaatgtgtgaaaagtttttcattattttgctcattcaaataatatgatagtattcgaaacttcgaccaggttgtaatatttttccaatctaggcgaacggtaaaagttattttacagaaaaatgtctatagtatctaaattcaaaggtttcttctggaggcacaaaaacaagttcatagctggaggtgcactagtaacaggaaccatcctactgtcaaaatatgcccaaaaacgattgaaagaatggcaagaaaaagaaacggcagagtttttcgacaggagtcgaaagtccagtcattttgaaagtatagaaagaacatgcaacgaaacagttaccaatttgtcttcggcgttattagacgttataaatgagactataaacacagatgttctcatagagagtctaaggacaaaccctgaaaataaattagaaatatggaataagctaaaggtcatggtgtttactaaagctgcgactataatatattcaatagcaatgttagttataacattgaggattcagttgagtattgtaggaggatatttgttcaaagacccgaatgctgtaccaacagaaattcaagagaagtatttgtcagtctgccaaaatttcctaagagaaggagtgatagtactaacaaaattggttgaaactgaagttaaaaagtgtgttgaggatttagaactcaccaaacaattgaaactaagtgacattgaagctatattttggacagtgcagacaaatttagcgacacacaaaaatagtcctgtggaatgttttgcaagttacatcttacgaaattccatttctgaccccgccgatgtgtattgtaatatgattcgtgacactgaagatttcctagacagtgatgaaattaaatctatcgcaactcattgcataaacagaggttttgtttcaatgggagatcaaatagcagaattttacaatcaaaatgatttgccaactgcatcaaatggtcaagaagattgttttcgaaatccattcgaaataaaaaaacccattgcgaaactcataccaattataaatgggttactgtcgaaacaatcactacctcagcattttgttcagcagttagcgctgaatgaaaaactgcagatcctaagtgctaatatttatgaaagttcattttaattctttcctagagtttgtgggttgaattaaactatgattttagaaatgtcaaaaatggcaaggttttcttgtgtttcatgcaagaagagttaatggttatttttatatttttaggaaaatggcgtttggagatgatcgatgttaataaaacattttta

SEQ ID NO: 617 - DNA, 3008 bp, Leptinotarsa decemlineata
  Annotation=Transmembrane protein 43-like protein; Tribolium gene name from OrthoDB database=TC013551; Blast E-value Tribolium Gene vs. Leptinotarsa Unigene=9E-159
atataaatattatttctaatcagattcttaaaaaatcacttatgttgaagagtttgaatggcataacatcataatctagaaattgataagcttcatacaatttgatgcttcctagtatctgtaagttaagtttaaacatatgtactgccttaaaaactcatctcattagttcactaaatatgccttcacagattcattttttttccacgccaaaacatactcctggcaccaaaacttttagttttccacgaaattgacgcccatcaacgcgtattttccaaattcctaaatccagcgatcctgacgtaacctatttgaaaaactgttttatcatcggcgacattgatgaaataggttagcaatttttctgctgccaaaggatgccaaacgccaaaggtgcaagctggattatcctctgaatcgtagtaatggcatcgtcttgtgaccctcgtggaaggaacgtattcgaatacgttgacgaagttacaaaagggaagcagaaggcgaatacctaaaaatccggacgatggaggattccgcctcaacctacttggcgagttatcttgcagaaaatcccacaaatcccaaatcgactgcgggttcaagagaaaaactctggacttgggatcgtttttccgaaacgccatatagttgggaaaaagattgaattccgggttttccagccaactgcctatagaagaggaataattgctgggatcccacgcaatcacggtgacgtttttgtagagactggatttgagaaaattgaactcgggtttagtgacgacttgggagttcaaaagacggatggttgtttttttgccgacgtcatcttcgaagccttgagtcggggcgttgttgaacctcatcaccaggtcgtgcgagtctattagcagtcccagattagaatctttcagcgcccccgcgcttgctactatggcgcaactgttgaatcgtttgttttcaaaaagagctcgtttcggaataaagtctcgcaggggatgattcccgacgtcgctcctcctcaaagtcctcaacgttgtttctttcaacttgtacaaaacttcttgcggcgatttgtccatgaaatttcctctgacacccttataattcacgttatatgggttttctggtccaacccttaaaacattactttcgtcggtgaatactttcctcagttccttcattagattttctttgaattcggacgtttttttatcacagtcgctgaggctatcattcttccagcagaaatatcgcttcgagtctagttcaaaatccttggcctggaggttcggaaaacgaggtttactattcttaattaaggttattgtagagttttctttgatgattgaatgttttattctcgtctttggctcagaagcggtgatggtgctattgggtaaataacccctattgtagaaataaatctgttggtcatacgtagatgttgttttttccgtctgacgttccaagtacatccagtattgtgaccagagaaggtacatgtagccacacatgccaaaaaagactaaatttataaagacccatgtcgacacaaccaaagcgcgcatgttacaatataaattttagttaaatgttaaatgtaaaacatccattatttacactctgtcgcattgctagtgtagtcatctatatgactctagtgacagtgacatttaccagatttacttacctggattctgattaactgaacatgcgcgaattttgcaaaagcaataacaaaatgcactaccaaaatcaaaaattcaaaaaatgaaatggcccaactattagacgaatttcaaagaagttgggtaacctctgtgataggaatttccttattttttttttggcgtttggttactaacgtggaatgagagtagagctgttcatcatgcccattctctggatgaaacttacaataatgccatcattttgagtccttatgaccaactcgataacaacaatgatggaaaagtggtgcacattagtggtaacctaaagattgatgaaccattaacagagttcgattatggaatatccatacaagctgtaaaactgaaaagacgggtacagatgtatcaatgggtagaggaaagaactccaagggatgatgatgaaacaattggaggggcacagtattctatcaatgattattattacataacagaatggagagatagactggttgacagttccagtttttatgtgagacatggacatgaaaaccccagagatattccattgaaaacaatcacatatttggcttctgatgtgagattaggacagctacaagttggaaatgatatcatagaaaagttcaatgattttatagaagtaacaagtgatgaaagacctgaacgcagggatgtcaaattacatatgggaatctattaccactgcgatgacatatggaatccacaagtaggagatataagagtgcaattttattatgctggggcatctggagaagcggttaccatcattgctaaacaagagaatggggttctggtaccgtacgaatcatcaaaaggtcacaaaatagctctgctgagacacggaaaccttaacattaatcagatgttctcagctgaacattttgatgctcgtctggaaacatggaaattgagaggtctgggagtttttattttatatgcttcagctgtgtgtctagccaagcttctacgaatattattttttcagatgccagttttggactgtttcattactggagaccctatgtcacttggaaacgtcttattggcaatatcagtctcactagtcgtaattgccactgcatggattctttataggccaatgctaggggctggcttactacttgctgctgtcagtccacttttgtatacggtgggtgtgtatgatgttgtacataatggacatattaattgaatctattgttcatttagacagaaaataataaacattattagaaactaaaaaaaaaaaaaaaaaaaaaataaaactactagtacgttagtaataac

SEQ ID NO: 618 - DNA, 467 bp, Leptinotarsa decemlineata
  Annotation=F13E9.13, mitochondrial; Tribolium gene name from OrthoDB database=TC004031; Blast E-value Tribolium Gene vs. Leptinotarsa Unigene=2E-77
ggataaccccgtcagaaaggaaaaactctgctgccttagcagtgtcaacaagcgaaatatctcctgttattgcatgtgaactgtgttttttcttgatatcggtgaataccaaaacattttctgcttctatttgttttctgtatctcagtaacactcccgcatttgcatctgtaaagccttcatcacctatgtgactgaaaacgtatccctcggctctaatgaagttcatagaacatgcttttgctatggctagtgcttccttgttcccacctgataaaacctgaattccaaatggtgtagtattgggaatgatttttcttagttcagagcatattctcgttaatgtagctgttacttctggaccaaaatgtttggactgtatgtacggaatgtcgtgcatattctcaactatcagcccgtcaatatcatttttgaggtatatctcggtttcttgacaagctttagac

SEQ ID NO: 619 - DNA, 790 bp, Leptinotarsa decemlineata
  misc_feature (11)..(11): n is a, c, g, or t
  Annotation=Protein SERAC1; Tribolium gene name from OrthoDB database=TC030742; Blast E-value Tribolium Gene vs. Leptinotarsa Unigene=9E-37
tctacagtcanatttttttcatgttccattttctttcagtacgtctttcagtatgtgaagtactttttggtacaggaatgaatgcctgaaaacaaataaaagattagatttgaaaatgaaacagtaaaaccgtcctcagataattttaaatcaactcctgcatgaacaaaatgtaaatccatataaaaaaatcatgtactttaaatcattccttccaaactcttactttgttagaggtttacaaattccgagatgatcctggggaacttcgtaatattcaccaacaccaggattgccggaatttggttccactaataaaaaattcaacttcatagctgtcaccacagtagattttgtttcaacgaatgtgactattttcattggcaccgcttgaacgattttgagaaatttttcgtgaatttttctgagctgcggagaattttctcgaagttcacgaacttctaccgatggccagagcagtagggcagtagcctgactcaaattcgccaatcttgatccattgtggggggtgctgtagaatactatacccctggtattcaaacaaacatttttacggcaagattatcgcaatcgaaagctttggataagatattttaacgattaaaccccccatagaattgcgtcacccaaacgataggccgctgcccaagtccggcatccagcaacttcttcagaaggtcatcgctacgttcctccagagtgaacttgactttttctgtggggtcaaatcgatgccacatcgataagtcttgtctcatagttgatacct

SEQ ID NO: 620 - DNA, 1292 bp, Leptinotarsa decemlineata
  Annotation=Protein SERAC1; Tribolium gene name from OrthoDB database=TC030742; Blast E-value Tribolium Gene vs. Leptinotarsa Unigene=5E-122
gtcaggggaaatttaaaaaattgtatataataatgcgatatccaaacaatccaaatttattgaagtatataagtttgtcaatagttggaactagtgcaggatgggttctttaccaagtgaagaaaactcgagaaatattagaaactgcagtagacacttcagtattgaatttgaaacctgttatacccgaagaagggagtatgcccgaggagttcgttgatctgcaatccttttatccctacaacaaatccaacattttcaaaaatacttgggattccctgaaatttgcatacgccaggagattggtcagactagccagtagcaaagacaaaactgacagagtaaaagctgtcagacatctagttaaaataaggaatctgaaccagtggcactactctctgcttgccaatatgattgattccaaaactgctataggactagcgagatccgatgatgttgataaacgcttgctacttgaaccgccgttgagataccacaactacaacagaactatgttgataagtgctatgagggagtttctgatcaacctgcacgaaacttcgcagcatccctgtctggggttctttttgtcaaaggtgtttgtttatgaacatgacaattcccacatagtggacaatgactcctctgctctcgagttgagcaaattcatccaatcagaaagcgacgtcctgccgaaatgtttagagtctcttttgcaccacgcaagtttagaaaaatacgccaaagacatcgtgaacttcaatggcttaccgttgttgatggaaattcaccaccggtacaaaaacaatgtggatatcactataaaactctgtcagatcctgtcgtttatgtcctttgacaggagtgtcctggaaccgatgcataaatcaggttggatcggcattttatcggagtggatgaaacatgccgatgtaagagtttccataccggcagcaagagctctagcgaatttagattcagataacgagcacttgtactccaggcgactatatttattacatcccatgaggagaaccctcactgaccagaatatagatgtcgtcttcatacatggattactgggaggcgtattctacacgtggaggcaaagaaacaaaagtcagaacattctcagtatcatcggtaagaaagagaaaaaagatagtttacagttgaattcccagcttccgaaagatagcggccagaaattcccgtctgaaattcttcaggaacatgaaggagaaccccgagtctgaagagttgtgcaaggactacgaaatcgtagagacacg

SEQ ID NO: 621 - DNA, 500 bp, Leptinotarsa decemlineata
  Annotation=Ken, putative; Tribolium gene name from OrthoDB database=TC003707; Blast E-value Tribolium Gene vs. Leptinotarsa Unigene=4E-14
gatccaccaccgcgttttcagtgagcgacgaaaccgctgaaagttcctcccatgcgacggcaagcagcaagcaggcgctaccagcagtacaagttcgtgagtatcgttgtgagtattgcggtaaacaatttggaatgtcgtggaacctgaaaacacatctccgtgtacacactggtgaaaaacctttcgcgtgtaggttgtgtgtggctatgttcaaacagaaagcccatttgctgaaacacttgtgctccgtgcatagaaacgttatatcctcaagcgacggcaattcaggaaggttcaactgttgtttctgtccgctctcatttgaatctcttccagaactgataagacatttatctggacctcacaacaatttgctattgagtaaaaacatgcatgagctcaagtagctcaaattacattccatttcccactgatgaggtcgtacagaatattttggaacgaccgcatcttgtgatatgctgaacctatcagtgcct

SEQ ID NO: 622 - DNA, 1416 bp, Leptinotarsa decemlineata
  Annotation=GMH1; Tribolium gene name from OrthoDB database= TC001757; Blast E-value Tribolium Gene vs. Leptinotarsa Unigene= 8E-96
gatttgttgatggattgatggtgaagtactcgtaaattttaattttattaggtgcagaatatataaattttttttttgccgtatgaccaaggttaactgagtattatgtcagttgatcagcttgaaaaccaaaatcctaatatttacaaaagtatcgaggaaaggccttgtacccaaaaggaattggatgattcagtcgttgacgagtttgacagtagagaaatatttgatctgattcgacacatcaacgatccagaacacccactatcattggagcagcttcacgtcgttcaagaagatctcattcgtatagacgatggcaacaatacagtggacatttacttcactccaactatacctcactgtagcatggccacactcataggtctttccattagagtccagttgttgagatgcctacctgcgagattcaaagttaaagtcgaggtgactcccggtactcacaatgccgaacaacaagtgaataaacagcttgctgacaaggaaagagtagctgctgcattggagaattcacatttgattaaagttataaatcagtgtatcgcgttgagaagaagtgcttgaacctgcaactatgagttctaacagggtgtactctgcatcgccttgcgatatctcttctgcatataataagtgtgcaagatacatgcgaaaaattttcaagtttgatcagatggattttcagttcgccctgtggcaaatgttatatttgtttatcgcaccgcaaaaattgatcaaagtgtttagagctagaaaactttcaaaatcccagtacgcccgtgatgaccctgcgtttttggtactctttgctggagcactcagtatcaccactgtaggattttccattgtgctgaaactatccttccttcaattcgttaagtttttattttttgttgtattcgtggactgtattggattgggacttttagttgccactttattttggtacttaaccaatactttcttgaaaccaaaaactaatctacaggacgttgagtggggtttttcattcgatgtccaccttaatgctttttttcctccgctgatattactccacttcatccagttatttttttataatggaatcataagtcacgactggtttttgtctattcttttgggtaatactttctggctttgctcctgtttgtattacttttatataacttttttagggtataacgctctgcagattctgaataatacgagatattttttggtgcctgtaccttgggtggttttgttgtatttgataagtatatttatcaaatttaatatatcccataatctgatgagtttctataggtatagagtgttgtaattttagcaagctaatttgttttgcacgtttaatattatgccgaaatattgaagaataataaaaaattaagtagt

SEQ ID NO: 623 - DNA, 1148 bp, Leptinotarsa decemlineata
  Annotation=Putative methyltransferase NSUN6; Tribolium gene name from OrthoDB database=TC011859; Blast E-value Tribolium Gene vs. Leptinotarsa Unigene=3E-72
gtgttccgtaataacatattagtgaacagtgtctcgtcaaataataccatgccttatccagaatctccttttcaagaaatattcgaatcagagttgattactcattcatctgaaaagaaatgtggaacgacgatttcaaatgaagagttacagaaaattttgaaatggttgtgctcttttccaaaaatcagttcgtacagggtgaatactttgaagtgcatacctaaagatgttttggacttgatcaataaatattgtgaagaggaactggacaaacaacccaaagtggaaattcatccttcactttcaaacgttattattattattcatagtgaccctaacgaaagtatcatcgagaaacacgagaacgaagtcatcattgatactgattgtgcttctgctgtattaagaggggctcacatatatgcaccaggagtaataggaatgctgtcaggttcacaattgaatgataaggtcagtatatatgccgacacattgaaaaaaatgcaaaaaaaggacttcagaaaaagtttgaggaacaaaagattttcatcggaaatggaattgtgaagatgcggaggcatcaattgttcggagaaaatgttataccaactggcatagctgttcaggtaacagagacgatatccggatgccctcctttgaaagacgattttatcccttcgggttgggcgctactccaaaatttaccgtctgtgttatgtgtgcttgcactcaatccaaaaccgaatgaaatagttatagacatgtgcgcttcaccaggcaacaaaactactcacattgcggagctcatgcaaaatacgggtctactggttgcaattgataaaactgcgaagaaagtaacccaactggaaaatcgttgtgaagaattcgacgccaaagtacaaatttatgaggctgattcaagaaacattgttactccgacaaacctctttacgcggaaacgtgtcactgatggacctccattttcaccggaatcgttcgacagggtgcttctagatgccccttgtagtgttcttgggaagaggcctcagatagtaaatagattatcgaaaaatgaaataaagtcgtacgttccactgcagagaaaactgtttgagacggctgttcaactcctcaaacacaacgga

SEQ ID NO: 624 - DNA, 1021 bp, Leptinotarsa decemlineata
  Annotation=Deoxynucleotidyltransferase terminal-interacting protein 2; Tribolium gene name from OrthoDB database=TC000065; Blast E-value Tribolium Gene vs. Leptinotarsa Unigene=3E-74
tatatgaactattcgtaggaggtggatggtctactgcaacataaccgcgtaacaaaatttttaatacacgtgaaatataattacgtatatataatggattttgtaatcgatacagttggtgatacggctgaagagaaaactccttacggtcccgttagctcctttttaacagaactattcagtggcttggaagaacccagcaagcagaaaccaactgttcccaaaagtaaaaatgtcttactggaagaaatacttgacgacttgaagaggcctcatgcgaaactacacaaaaaaaagaagtctgaaaaggtggaggctttcaaatccattgatagacaggaagtacaaaaagctcttgcaaagtcagttttaacaccagagtttgaaaaattacatgttgtcccaccatttgaggtatctgagaggaagctaaagcaacagagaaagaaagaaagagaaaaaaccaagggcgataaatggtttggtttaccggctacagagatgaccgaagaggtcaagcaagacttgcaagtgctacaaatgaggtctgtgctggatccgaagcatttctataagaaaaatgatctcaaagttcttccgaaatattttcagataggaaaagtaatggattcccctatcgacttttataatgatcgaatccccaagaaacagcgcaagaaaactctggtggacgaattgttagcagacgctcagttccagaagtataacaagaggaaatataaggaaatcatcgaggacaaacagaagacgcattacaaagcttggaggcaggcgaaaagactgaagaaaaagaaatagaaaatttttgctcaaaagaaataaaaagcatttattaaaaaaattgcttgattgaggttatttacgtaacataaatgtaagattaaatttgggttctgtagcatgagcaagtttaattttataaacaacatttactcaagcaggaaatttttatattcacttgtataatgttccaagaaattttcttcaatttcatcgaaat

SEQ ID NO: 625 - DNA, 1205 bp, Leptinotarsa decemlineata
  Annotation=KRR1 small subunit processome component-like protein; Tribolium gene name from OrthoDB database=TC007222; Blast E-value Tribolium Gene vs. Leptinotarsa Unigene=9E-167
tataacaatttattaacattatattgtttaattacaacaaactcttcacttttcttttctcttaacaagacctttcacaccttttttggctttggccactttttcttttagagcagctatatctatactagttttagtattagtactagcctttgaagtattaggctcctcaggaggtacgaatgcctgattccttctctcttccctcttcttggcagcctcagcatgcttttcatctttttctttccgctgtttagcttgctttttgtgttttactgagaaagtattccccactagcaagttccttatcgattttgctctcttgttgaggaggtggaaagggtgtgtacggtttcttctccttcttgttctttggttgtttccgtttgctgatatttttattgacaaacttgggaaggaatctctcccagttttcatttttcatttttggatcttttgctaattcttttttgatcatcagagcttttatgttataaattgggtggacatttttcatggtatcttctactatttttctgacttgttgcaatcctttgtatgggcccaaggcagacacagtttggccctgcacgagaacataacaattggttaacagttctatagatttcaaagtacaaccattggggccaataagcctttgccttcgtttaacaaatttttccttattgcgggtgatttttcctatcttgattatatcacaaccaacttcatcttccaacacacgtttagcttgctcaaaaggaacactacgtgacatcaattttatcatatccctagcttttatgatgatgtaaggatcccaagtttttcgtgtcgttcgaacagtcatgcttccttccaccacgtctagttcagctttgatgaaatgttccgagagtgttttctgaactaaaggccaaatttgcctcaagtattgttctctgtattggggaaaaagagtggcaaaacagctttcttctaacaagccatgtgggttatcttctggtttgaactcaggaattttcaattcccaagcattgtcaactgggccggacacagtttcactttcatcttcagagttaggcattattgaaaattgtttaaaaaaaaatgaaaatacaccttcacaactgaataatcctaaatttgtggcttgattgcctcaacctcaagtatcaattgtttactaaaatctaacctcaagt

SEQ ID NO: 626 - DNA, 1882 bp, Leptinotarsa decemlineata
  Annotation=Putative uncharacterized protein; Tribolium gene name from OrthoDB database=TC010883; Blast E-value Tribolium Gene vs. Leptinotarsa Unigene=0
cttcataacccgaaataagtaattaagattatggacaacattttgaatattttagaactttcccaaggaaacctcttgacccaaaagataagataaaatttggcaatggacaggtttcaaaagtttcagtttgtgtaaatgattaacaaaaaaattgtgtagttttatacaggtaatggctattttgaccacatcgtcacatgtcatcctccagtcaaatttatatttgtcatttcatgtgacaatctttttatttttgcgggagattgaaaatgaactgaatgcattaacaccttagaaatttatatttttattcgtctgaatatgccgattagtcgattggatgtattgtatagaaaattagttcttgcaaaatttttcacaaaaggttggggatcacccaaacttttgaagaggttatttgagttcagaaggataatatccaacagagaaacttgttaccaactaattcctacagattatcctgtaacaattgtaaatgaaatcaggcattctgattgtcgagtattagaaggaaaattcagaactcctctttcaatgtatctgcctggcttaattcgcaaagaagtgcaagactgcgtctttcaaatggttctacccatagaatggaatagtacttacaaaccagtttgtattcatttcgcaggaacaggagatcactatttttggaggcgtaggaaaattatggcagagcctttactgaaagaaggtattggagctatcatcttagaaaatccttattatggtactagaaaacccaaagatcaaataagatcgagtttacattatgtttctgatatatttgtcatgggtggctgcttaattttagagggtttagttcttttgcattggtgcgagaaacttggattaggacctctaggcgtcaccggaatttcaatgggtggacacatggcttctttggcagcatcaaattggccaagacctttagtgctagttccttgcttatcatggtcctctgcttcctctgttttcactgagggagtgatgagtgaatctatagactgggacatgttacaagaacaatttatgtcggacagttcctacagtgatgatctctctaagttatgcacaatagtagataatccatttgcctgtgatctttctcatcttccagataaacttttcaactcgtcatatcttccgttaaaaggcaaagatgtagccaacataacaccataccagttaatcaacttgaagagttgtgctacttgtccggatattgtactcagacctcccaccgaatctgtagaaaaaatgtcgtccaatagttcctcagtcaccaattttttcaagagtccagtccaaataaaactaaataaggttgatgagatgaagaagcgcgatagtgaggcaatatggttcatgagaggtataatggatgaatgtactcacttgaagaatttttctgtgccatttgatacatctcttataatttctatttgtgccagtgctgatggatatgttcctaggactggactctctcatttagaagatatatggccaggtgcaacagttaaatatgttgactgtggtcatgttggtgcatacatttggcatcgtaacatatttagagaatccataattgaggctttcgagagagctaagaaaaagtataagcctctatctgctcaaacagataatttataattgactgataccaagtattgtgattattcacctggtgcctttattaaagttgacgtgttataattttgtaatgttgacatgttataatgttgaattttttttaaatgttgaaatgtacataagagtttatatttctgatttgtgtacatgaccaaaggtaaaattttgtgatattttacaataaattgaattt

SEQ ID NO: 627 - DNA, 2068 bp, Leptinotarsa decemlineata
  Annotation=UPF0171 protein CG8783; Tribolium gene name from OrthoDB database=TC012039; Blast E-value Tribolium Gene vs. Leptinotarsa Unigene=0
gacatcgaagtaacctaatttttgaaatgatatgaattgaaagttaataccgataacttactctgcaaataaaaaataagtttgaataatgaaaccttttaatgaacaaattccacattaaacaaccaaaaatatggaagtgagcccaataagtataatattggttaagtcagacagtaaaggagacagattattgtttcgttatccttttcacatacagaagaacagggaaacttctagttcacaaagaaaaaacccgtataccttaccgataacagaagatttactccaaagtcccgcgcagctatgttcaaatataaacagagaaaatcttacaggtttcacagacgaagtcctttcttctttgttcgtggtgaagaaggaattgtgcaacaaaaagttcgaactcaaagttaatgacgtgaggttcgtgagccatccgacccttctgcagctgagaaataaacaagaaaaagaggatggttctggtattatgttagtgaacatcgtatttgctttgcaggctcttgctagtcattccgtagttaaatgttatcatgacttgagtaaaaggatgggaatagttctgaaatacgaagaaaaaagatgtggttatgtgtctgaacaaacacagttgatgacaactgcacatgatgacatatataccaatggaccaggaagtgcatttcaaattattttggagaagtgttccctagctagtaacatcaagaagatgtaagaagatttatgtaacacaggactggtgaatttaaggataaacaaatggataccattgagcttttgtttaccacaaaaggtacatcaatggcatatgagaggaaaaattgttgaaccggaagatattgacaggtgtatgaatgcccttagaccatatcacagtttacttttactccacccattgcaacaaatgaacgatttctcttcattagatggttctccatctttagttaggatgttatctcagtattcacctttgaaaaatttacagactttagcggtagattcggatttaactttatcacatgtttttgaactcacagcacatctagtatactgggcaaaggcaacagttatatttccattatgttctacaaacaaatacgttatatcccccaatgcccctgttcatctgaactcgcctctggtagaaaaattcagtgatacctttcctggccttaatctggttagagtaatgagcgaatactcgctacctacttcactgggacagaaatgtaaccctttgtgtcatccctcacaacaatcacagttggttcagtcgattatttggatgttacagcatcatctgctgcttcagttacacacctacattcagtatatgcctacagaaaatggacagttgcgtagaaatatggatgaaaacaaaaaacacctagcatctccatcaccaagaagcagtactgtcatgtcaaattatcaacaaacaagcaatgattattctagagcggaatcagaaagtggtgcttcaactgtatctgaaactttggaagttgcctccaaaattgtgaatttagaaagtgcaagttttgcttccacggaagaagacaaacaggactatcaagaagagcttcttctggatttcccagatgaggaaagaacgtccatatttaagattcctgccaccaatactcctgaagacctaaaactctttgcaagattgtgcaggaaagaatattttcaaggcaatcatcacattgaggaaatcatgtatttggaaaatttgagaaggagccaattattgcaacttttagacaaatttcgagatgttctgataacttatgagacagaagaccctgctatagcaatgttctcctgtccttcatagcatctttttttgataagcgatagtgatacaaaattgatttgacatgtgattcgaatttgagataaattttaacttccatattactttcatgaaagatataattgttattaagtaacttgattgatttttgaaatctatcttcacctagtgctgtgtttttactttatacagatgtttttgattaccttatttatacattctatt

SEQ ID NO: 628 - DNA, 852 bp, Leptinotarsa decemlineata
  Annotation=FAM86A; Tribolium gene name from OrthoDB database= TC030573; Blast E-value Tribolium Gene vs. Leptinotarsa Unigene= 1E-6; Blast E-value Tribolium Gene vs. Leptinotarsa Unigene=0
ttcaaagtaaatttaaatatcttcacaggagtatcattggccagaaaaagtttgttgaggaggaacttcagttttggtggcgacaaatgatgctgaaaccatttttctcaggaatgtatcgagtgtactaggatttctttcagtgcaagaaaaaaataaactcttccactccggaaaaaaccgccagattcttcatagcctttatcagaggcacgaacaattcatcatcataaacaatatctgcagctataacagtttctactgtaccaagttttttgcattccccctcatcaatttcctcccaaggaagattcagtacaagagttgtagctttggaattatgatatagacatctgtgattcattcgagaacaattttctaatatttctgacgtatccttcagtacttcatctactgaatattgcttgaggtttctctctacattgtaacgcaggattttcagaacagtttcgtgacagtctgttagaaagacacattttgctgaacattctctagcaagaaccagtccagttagtccaattcctgatcctagctcaagaactgttttgtgggtaaacaaacttttgttttgtagtagccattctgaaagagccagagatgcctgccaagtcctcaaaccagtcgttccatcagatattagattactgctctcctgtaagcttatgaccttgtcgtcagttccgagtaaatagtgcttgaaacattgagaacttgatcctagcgccaccagccgaccgtaggcggtatataactcatcgcaaattacagtttcctgtagcgcgccactctgtaagtttttccaagttttgtattaaatgtttcaggtataac

SEQ ID NO: 629 - DNA, 1180 bp, Leptinotarsa decemlineata
  Annotation=mTERF domain-containing protein 1, mitochondrial; Tribolium gene name from OrthoDB database=TC013123; Blast E- value Tribolium Gene vs. Leptinotarsa Unigene=1E-1; Blast E- value Tribolium Gene vs. Leptinotarsa Unigene=02
cttcaactgaagacttggcaatttcagtactgaactctgaatcagttccataaaccaaattagtcaatgcaatatatttaggttcctttggattatactgagccctattcagcttttccaagaataaatgcctctgcattagtcttttctgtcggcaggttaggatatctggcatttcaactatccattccaaaggtattttcattgttgtgtgcaaatacatgaaagttctgagaattttgttctgatccattctgagcagttttggtttgtcaagcacaatcttctgtaattcttctttagaaaatcccatttcttcttttaaagcaaatatattcactttgacttttgctagaggccatgtgactaatttcggcgattttgcagcaagttgtctaacttggtctccagtgagaaacaaattacgttggaaaaatcctagtcgtttgtcaatatcactagtgctgtgagataaccacatggcattaatttctatgatcctcacaatcatatcatcagtgaattttttgaactgaaggtagtttattctcaccctaagatcatccagatgttccctgagtaaaaatgggttttttgtgattatttctcctatcttttctgtcgatactttcaagtctttcagaaacagaatgtgatcacgatagtcttcaaactttaagctgagaatgaatgtgattgcttcgggattcttttctatttcataaaacttcacacccaactttaatagttcctgcagactgtctgatttgttaatatagagcgaagttacggctccaggtctcaagtatttagacaagtctgatactttggttcttcgaggtttttccaatacagaatctgatacttcggtgttctttttactaacagatgtgtcataattttcttttttgagtgcgaggatctgtgcagttactgataatgacttttgttcatttatctgtgaacaagtggaagtggactcaataagactgtcaggaacagtgtttgaaaacttttgaaacaaacatttcaaattgtttttgttagctaatacagcataatttgttatttttcgaaacattctatattatgatttttaaaatttaaaaaacgactgattgcgagacataacctcaaaactttactttttttatgcgacatcacagaacaacacagaact

SEQ ID NO: 630 - DNA, 2955 bp, Leptinotarsa decemlineata
  Annotation=Pre-mRNA-processing factor 6; Tribolium gene name from OrthoDB database=TC005794; Blast E-value Tribolium Gene vs. Leptinotarsa Unigene=0
agaataaattatactctattttacacataattttcaacttaattctagactggtataggtacttcttttgctaccgcatgtaatgtctgttcagtattcaaaccaacatttctgatttgtttagaaacagaacaccatagttctccgtggtgtggttcagcatctaaacatcttttctttacatcttcttgttgctctttggtaccatgtaattgttcaaaacggtacaaatacgcccaagaatcccccaaatcaggttcaattttcaaagtgcgatgaaaccattcacgacattttgcaatctttctttcagaccaaaagagtttgctcacagctaataaaacatgaggatcgtgttcacattttttcaaagcatccaccgattttgtttttctttgtggtctaggttccatgaaaatactctcggcccacaacacaccggacgtaggacaatcctgtaatgcctttgccatcatagcatttgcaatatccttcattccagctctaatttcaactcttatggcttccaaccacaaatattcatttttaggattcttcagcctagccttctcaagaactgaacgcgctttgataagcaatccacgtttctcttcgagccttgataacagaagccatagtggaatcgaattgggacatttttttatccctgcattataggcgtcaaaagcttttgacaagtcatttttctgttcttggatctggccgaacatcatccacagtttcggataatcagggaaaactttcaaagcttcatctagtaacttcagggctccattaagatcattgagtgaccactcaagctttgcacttttcatcataactcgaggagttggagcagatcctctagctttagccaaaagtcttctagctctttcatattctttgttttctgattccagtttgacagcagccaaccaaatttcttcgctgttaggattagcctggaatgccagtgataaaatgcctcttgcagctggtacatcgccagctaaccatttactttttgctcccattaaccaaagtacctcactttttggacaatgagcaacagctctttgaagaagattttccaaactgtccctcgatccatgattcttctctaaataggcagctcgcaaccagattgattttttgccagggaaagcagctaaagcaatgttgtacactgttctggcacattcataggctccttgattaatgcaatgttcagcatcctccatccaagtatgcttttgatcttcctgttcaactccataagcaataatagatttaacgattgctctacagcaatgtatgtgtcctccagtttcactttctatagcttccttgaaccaatgttctctgttgatttcgaccccattagaactcaaggatgttatagctctttctattattttttccaccatatggtgatttccgttagcctcttccaattttgcagcggttgtccaaatctgtttatctgttggaatattctctcgagctttgttaagcactttccttgcattttcatatgtttccaaccgagccagagccaaccagagttcaactgctgttgggcaacattctacagctcgagacagtagtattctggcatcttctggattttccatttctacagctgctttccataaacgaacagaatttggaatgtgttctaatgccttgcgaaacaccttcctcttggctttcatttctgtttctaaatcagctgcttttatccaaattctaactgaagtaggtatatgccttgcagcttgagctataactgctttagctgtatctgccgaattgagcctagcagcttccaaccacaaatcttcactttggtgattcacttcgcaccctttcattatcaggttcctggcagcctgcacctttccagtaacttcttctagtcgagcacttgcaatccacgcaggagggtgattagggtttgtttctctgacagactttaagagcaaacgtgcctttttgatgtcgtttatatctcctccatatgtagggatcattgattgtagatctgtgaggtaaccttttgggtcaacaactgtttgtccagtaacagagtccgatacttgtgacaatttcacattcattaatgtgtttcttgcttggccaatttttctcaagtccatatctcctgttggtgtcaacattcctggtgtcattactccgggaaccatactggccaaaccagagttgggatctaaagatgatgttgcctccccacctaaatttcttgaaagaacactgtcaggaagtggtgtaaatttttctgccctggggtttcgttgtttcttgtttctagcatcacccacttctggtaccgatttccactcgtcttcactcacggctgccaaatctcttttaaggtcagaaaactgctgctgaatcttaggcctttcctgacggtaccgttctaattcttctcttaggcgtttttctctataatcttttcgtttttcatccattcgtttgtcaattgattcataaatcgcgtcagcttctgcatcatccttgtcatagggatctttggagaacaatgatccaccataaccactaaattcgtcataattggtgtcattcaaattttcttcttcctctgtttcttcctcttcatcttttttcttgggtctcttggcagctggtggagcatggcgatcgtcggaaacgtcgttagcatctcttgctggaccaatatcagaacgagttgtgaatcctgtagcccctctgcctacaccagcaacatatccaagaggagccggtactcccagaaaatgttttttatttctattcactaaggcttgaggaggtgcagacatatttcaaatagagattgtttttcatgtatattaaataatatttgaattattttctttcataacaatattttttataactgcataggttgttttctacttctttctttcc

SEQ ID NO: 631 - DNA, 1006 bp, Leptinotarsa decemlineata
  Annotation=M-type 9 protein; Tribolium gene name from OrthoDB database=TC006678; Blast E-value Tribolium Gene vs. Leptinotarsa Unigene=1E-7; Blast E-value Tribolium Gene vs. Leptinotarsa Unigene=0
aatatttatttgctttgagttctttataagcaccaatgatttcttttttgttgtttttccagttgtctcctcaaagcatttggcaaatcttttctctttccttttctgtcaataacattatttgaaattttacgtaaactttccttttgtgtaggaactgacgtgcttttggtcaataaatccttaggttgaagaatggaattgaggagcaaatttttggttcccggtcttggtgcattttgttgtgttccaactttccttggggtaattaaagatggaggtgcatgagccacttccccaaatttaattgtatccttatatttttctatatcatcttcatgaaataagtttttatccatctttttcagcttcaattttttttgtcgtttttgccatttagataaccttggagaatccttttcattatttttcttctttttctttttattgctatttttatcttttttgagtttctttaaatacaattccaattcatcttttggccttttgacaactccttcaacttcaccatcttcatttctccggatttccaccccatatttttcttcgtaagcagcttctcgtgtaacatccatacatattctattgatgcgtttcacgaaatctctatcagactcgccttctgcctgtttaaaagttggaattcgtttggcttgttttgccttgagtacttcagcttcatttttatttttcttaggtgatttgccatcctctgatggcgatttttttaaatgtttggtatgataagttccactttttaccttgtttttcaagtcaatgaatctctgaagactttttgatatttgctgctcatctggtttcaaaggtggagcattgatcttatcttttatactctcaaatctagcggctgcttgtttttctggatctcttattccacgatgcttccttcccggaatttttcttcccatgttttagtctgtgagttctggacaccgacataaggttatgtcgatggttctggact

SEQ ID NO: 632 - DNA, 2153 bp, Leptinotarsa decemlineata
  Annotation=Transmembrane protein; Tribolium gene name from OrthoDB database=TC006278; Blast E-value Tribolium Gene vs. Leptinotarsa Unigene=1E-28
agtacttttttatgtaatctcaaatatatagacttaataaatcacaagagaagcaaaaaaaatcgtgaatatctgaacatatttggactttttgctgtatcaagcaccacatgacttattttccttctccattttcgaaattaatgatgttgagttgacgttcgattttttgcttcctgtttaggtaccctataaaatgtatcaaagacactaatatacaatatacaaaggttgaatgcaattgatatgaacctgtacgaagaaatacaatacccaataccgttgacctccatataaaaaaacttaaatcaatataatatatatatattacatgtttatttatacaaggcatgagatcttagtattctgaataattttactttgctgaaatacatctcacccatgtaattatgtactggttgtgactgtttataataaaaaattaaacatatgtcaaaaattgactatattaggcaagtaagtaaattcagcaatgtttatagcttactcgataactgtctatagtatgaactaccgataagtgaatcaataggaaaatgtgcattaaacatcgatgaagttacttgtcttactcacattcttgcaaaattcatatatatttaaaaagaaaatctctctcatcacaatattcacgacccaatttcagtaaaacataatataaacttagctttttaagtgttgcatttctaaatgcaaattatacagaagataagacaagaataaaaccagttttcacaattgtacttttttcaaaacataatataaacctttttttttaattgtttttaaatgctgtttcacaactactattcaactagatataccagccccaatttccttttttttttcaaagaataaatcattaaaatgaatttataaccagagatatgaagaaattttcgggagttttgttttctgtagtctattagcaatctttttttatgtttggaattgatagaaatttaataaatagtaaacatatagttgttcattccggctagctaactataatttttcaatatttcagaatatgtaacctattggatggaaagggagcaggaaaaggaaataaattccaagcgaaagtaaataaaatggtgaatcgcaaggaggctgaaaaatctgtttcagattattttaaggaaaactgaatttgtgagatcaagattaaatataggtttctcatatttgaactgcttttaaaagtcaactctgttgacatgctctcacagcaatgagttgaaggagaatgtacaggggagcgaatacttctgaataatccaaatttgtttgtcccagaagcctcctacacaacaggaacttaaacaaaaatgttgtcagcagaactgttccagaccagcttaccctcagaagggaaaatttcatagttctttctagtaacattcgtatgaaaattattatacagaagtaagcgttcaaagcatctcctgcaaatagaggtgaaaatatcaaccaccaatcgatggtattcaaatccacagaaggatcatatttgaatacaaatattatagtaaacagtagaatagatatgaggtttatccatatttcaaacacagtgagtcccagccacctcacaagttcctctgttgtgaagaacatttcagtcctgtttttctagaggatcctgtttgaaaattcttatacgtagtgcagagttgaacctccgttggatttcatagtctgcatcatcgactgctggctctaggtcatccaataactcagtggtgagggtatttgtatgaatttggtaggtgatgttgccgtcacatatttgtaacgctagcaaaatccccctttgaattgctgctcctaaacagtgaatgataatttctttttcgttgttgttaatcagtttgttacaacgttccaattgtgccttgatattggtttttgaacatacatacaaaacgttttctcctctttcaggcttccttggctgtcgaggacgacgattatgttcatttgtttttctgtgattttttgattgagtcgattttccgatggagtttttgtttatgttatccgccatgggagatcatcaccagtcttcaagattttacttgatactggagaaccaaatgacttatctgtatttagaaaaattcctaacc

SEQ ID NO: 633 - DNA, 3095 bp, Leptinotarsa decemlineata
  Annotation=A kinase anchor protein 10, mitochondrial; Tribolium gene name from OrthoDB database=TC012804; Blast E-value Tribolium Gene vs. Leptinotarsa Unigene=1E-81
tccattttaacactttcctattaaaattgtaaaaaattaaatatttgctcaacatttgaatagtcttcaaaacgataaactaaatgcacacattttcattaaatgaattttcgcactttgaatgcaatttgaattcaatcaaaggcaataatatttctctgcgaattttaatactttcacattttcagatactatttgaagtttttcaatttttgcttaaaaatatccaagtatgaaaacacacacctcagacaaacatgtatgattttttaaaaatcttgtgcaataataagagagcatcataatagagttcatgaaaaacccacatattaattaatggtatgaaatatgttgtacaaaaatcaaagcaaagattattataaggatctatcaagttattgtctattatgcgttggagttattgtgttgaataagctgagtaaaatgaaataggtctactgtagataacttgaggataccattaaaataacctttgaataggtataatttttgccatttttgtggaacattttcaattccatgttaggatctgactaggttttcagtgtatataaataaaattaacaaataaaaatcagtataaacatttttttaaagaatcaacatcaaaaatgaaaaaaataattttcttcttcaaatggcacatttggaagttactatgttgtaattggaataattaaaatttgagttcttaatcaaatgctatagattcctattacatatttcatgcaaaacaatttcatcattctccaactatacaatatatatatataaaaaacaaatgttactaaaacttacagattcgctcttttcacttatgttttacagaacttcaggtattttctctttttgctattattatccaggttactacttagtgaaacgcttagtttcaatttcacaagtatgcaaacctaaactggcagagactagattaatttacgaaacaaatggtgagagctataagggcggacccaaaaaaatttgaattggagtgagaatggggaaacccattattcgacctgatatctagtagggtcatcacctctgagtaagtgtacaaagttatttcgcttgagtgcatcggttcgcccgtgaaaaagtgatttcaaattgtcgagaacaacacgcaacagtgacattttgtttcctgtagaagaaatcggtgacttcaactattcaaatgctcaagcccgcttatggggatgctaccctgagtataactagagtctacaagtggttttcatgttttaaaaatggagaactatcaattgaagacctaccacatacatgacgcccctcaatgtcaagaactgatgaaaacgtttaacaaaaccaatgccttcgtttgtgaagaccgtcgccgaatcatcgatcaatgctgtaagaagtcaattcagttccagtcaaatttgactctcgccttctcacagacgagcaaaatttagagttgtgaaatcacctccaagaggaccctgaattactggtgatgaatcatggtggatacgacttcgaaataaaaagaaatcaaacctgtggaagacaccttgtatctcatcccgaaagagctcgccaactgaagtcaaaaataaagacaatgctcatttgtttctttaattgtaattgtgtaattgtgaaattatttttgaccatcgggacatccatataagtgaattgagaaactgttttgaattattgcagaactggtcagaaaagtgcattaaggggaatactttgttgtgaaaatattgagaaacaaaaaatttatgacgaaattcccgtttttcgggaccgccctcctattcagcttttgggaagtgaaagaattaattgtgcagaacttcattatccataagctgatgatgcatttttagtaggtatttgaggcaacttgaaataaaaaatactatataaatgttcgtaaatcttaaactgagagtctgagaaggtgtttgcattatttcttcaatgcccagtatatatttaaaaaaaaatgttaagtctaacgtattcgattgatgacctatttattttgtagaaatttgtattttataaaggctaaaattataatttttttgcaaatgtatgctgcacaataatgaaataaccacatacaactcagtctctcgatttcactaacatcaatattgtttgagttgcctaaaataatttgtcataagatcttagaatattctcattatgcatctgtgaaatgaaaatacttcaattatggttgaaaacgaatttaaatgaaatcacaaaaggaagaaatgttcaaaatcataccatttcagcagttaattaactgtttttactttgagaataaatagtttcaatactacctattgtcatatttgcttcctagtattcgttaaaaaaaaaattggtcataacctcatgattcatgattactcaaagtaacccttgttatatcttttacaatcatttcagctacttgccaggccatttcttctttttttctgttcacctcgtctgaatctaaggtcacaactttcttgagaacatttttcaacttgaattcctttctgtccggttcaggttcaaattctgcttcgtacttccctaactcatcaacacggccaagagacaacctttgaaattttttgcgacgccatagagagtttggatcattgagctctcttgtatctatggtcatgcctgaatttttttcagttctcctaaagttgctttgtggtacttctaatgccaaaaatgggtactgactgaaacttttttcactgctgcagtcagaaggagaatttctcttttcaattagtgttgaataaccattgcattgaacagtattaattaaatcagaaaggtacttgtagaaaagctgggaagctaagaagtttttcaaatgatttttgtcaataaatctttctacaattttcaatggcaggtgaaagcaatccaatatcaagccattttcaccacaaatactttgttcaacagcaaacctcactttgtcactgaatcctaatggagaaagtgcctgtagagaaaaatatttgtcatacaaaactacagcatcattctgggcctctataggg

SEQ ID NO: 634 - DNA, 1615 bp, Leptinotarsa decemlineata
  Annotation=Dentin sialophosphoprotein, putative; Tribolium gene name from OrthoDB database=TC009553; Blast E-value Tribolium Gene vs. Leptinotarsa Unigene=6E-3; Blast E-value Tribolium Gene vs. Leptinotarsa Unigene=0
cttgtattccatcaattattttataattatatattgatactatccctgggggtcaaatcacaaattcagttttcctttttttttatacagaaagtcgctcagagcgccccaatcacaataacttgttagtttgattaactgacaatcttttccattgaaaatatatccatcaagacattccagttccacgggagactgcttttcaaaacacctgaagaatttttgacagctatacttatggaaggcatattcatccgtattgcatgctcccaacacatggctgtagtgattgcgtttgtaatgataatttaaatcacacttattgatttgtgggttgaatcttgttttgcttggacagtcaactgaagttaaataatgtatattttctcctagaatgtcgacacatttgtaatattttgtttcatttgatggatctggaaaaatgccagaaccagaacacagtttcacaggtctgaaaagtacatgttgctgatatttctgatatgtttctttgtgagcagtacactccggtacatatttaggtagatcgcaacgacgttttctagcattgaattttagacaatttggacactcgtagactcctgacgaaataatttttccacactttttactgtagtaacattcgtaatgttgggtgcatgattgattgagacggaaaaaaccttcttcaaaacatggtcgatctgaatgtgtttgacatattgtagcggatttcccttcggtttcaacagtggcgtcatctggatattcttctgtggtttcatctgctgattccatagtctctgaaattccattgatatctgttggatttttagtagtcgcccctttctccttggtctggtccaccgatttgatattttctgatgtcttaatatcatctgctgagctcacgatgattgtttcattatccactgtattggctcctgaatttgttgtatccgatgttttattgccatctattgaatacttagccgttgtcttcccatatccagtattctttggatatcttcgtgttgcctcttcagaattttgatcatcagtagatgtttcttcaggattattctgatcttctgtttgtttcttttcggaaatatgagttacgtcagttggagacctttttgttttctcttcaggaatatcaggttgatttcctggtttttgagtagattttccatcatgattagtttgatatactgattgaccattttctgaagtttcgtccactggactccttttgattgtttctttaatttcttctgaagtaacattctcagaagtttccatgacttctccagttgttccagttgctgtttcttcagaaatgtcaggttcatttcccggtttttgagttgatattgtatcatgattagtttgagtttcgtctaccggactcctttcagttgtttcgctaatttctgctgaagtgacattctcagaagtttctgtgtcttctccagttgtttcagttgatgttttttcaggatgactttgatcgccaggttttccattttcagaaataagagttacgccaataatttttttgggcgttttatgttcaggaatttcagtttcatctccttgtttttgagttgat

SEQ ID NO: 635 - DNA, 1297 bp, Leptinotarsa decemlineata
  Annotation=Cytoplasmic phosphatidylinositol transfer protein 1; Tribolium gene name from OrthoDB database=TC005471; Blast E- value Tribolium Gene vs. Leptinotarsa Unigene=2E-154
atactatgaccatatattgaaataatattccctataatttataaaatgaacatatttaacagatatgtggatgctttttacgaataaaatacaatcaacaaggaaattttattagtcataacacaaacatctcttcattcgtttgaaacagcgtacatcaaaaaccaggtatttactagttcaaaaccaactagagaagtagccttttttagtaggagatttcggcgatttaggagtctctggtggtgaattttccaatgagaaagatgccgctgcatcagaatcttcggaaatttgcgacgataagctcggtgtttgagttatttccgccttgaacaaacagtttgtttgttgttgtaaattagtttcgaattctctaacgtcctccattgtcatctctacccattcgtcaagccaagcaaatgcttgtctatggccaaggagtaaaacttctcttatacaagagtgaataaactcttcgaccctagtttgcataccaaacacttcaaatgaggcatgaaccagtttatatgaacacattatgggttgataattttcccgccaaccatctacaagtggaccccggtgggttttcttcgattggatgaacctaggatcctcctcttccttataatgtttgggagaaacttcgtcatatgcaatatcaatgtgatccacaacacgttctgctagttgttcaggcatcaaaccaagacaattttctgtacatccattattattttcatatttagtttcgatggatatcctgaaccttggtatgaatgaacaagtatattcagtagtcgtatatgggtaaaagttccaagctttttcagtcacataaaaaatctttggtataatagattgcacccaatatggaagacgacttgatagatgtattcgtttttctgtgaactgtccacttccatgtttttcatctgaacattccctgttttcaactacttcaactccttcaccaccaccagattgttctagactgtgtcgcgctatcatatacagttgccctatttgatactcttccacagtcataggcatacatattcgatactctttagttagtaccatttctaaaattgttatctcctaaatacaaattatgtcgattacaagtcttttttttagataatgcaaaatacaagtgtgtttttggaatgcaaaatttgacaaactcaaatacaatactacagcgttgacatctgacacagtatcatcgatctggaatcaaatgacagcgtccaggacaataaagcgaaaaacgatacacttaatgtatctt

SEQ ID NO: 636 - DNA, 947 bp, Leptinotarsa decemlineata
  Annotation=DPH3 homolog; Tribolium gene name from OrthoDB database=TC009869; Blast E-value Tribolium Gene vs. Leptinotarsa Unigene=1E-4; Blast E-value Tribolium Gene vs. Leptinotarsa Unigene=0
taggttaacttttattataccaataattcttatcaataaaataaatcaataagtagcaccatcatctaagttgtcatcctcatctacatagctctctccattatcgaaataattgtttgcataatcagtgtcgtcatccatttcttcatcttcttcctcatcagcctccatttcttcattttcgtcttcttcgtcattcctttcaattttaacggcaccagattttacttcccgcttttccagttcagccaacttttgttcaatgttgacatctttaacaggtttaccactcacgacgcttttttttgccatcgacttaggccacagttctttgggaaaccgtttccaatcaaacttttccttggcactaggcagctgggctacgagtttatcgatagctcgttcgggctgatttttgttttcaggcaattttaggaatgaccctgataactgcatgcgatctatgaagttctgtcggacaattattagatagtccatttctgaagattgctctagaggtactggtcgtctctttaacggaggatacagcggtggtggctccagcacaggtcccggtaacgcttcattagacgcgatacccatggcagttagctggtccttggtgaaggttttcgtaaccccacctcggcctccacggccccctcttcctctaccactcattttattagttaacaacttcgatctttttgagaccctcttcgagatttctcatctcaccgtgctcctttctgaaagactccaaatcgtatatcaccttgacgactaaggaacaaccaggacaggtggctgtttcctctccagcgagtaactcttccttcgttatttcaaatctgtctccacaagggcaaggaaaatgataaacaccctcttcctcgtcgtatgtaaagtcttctatttctacttcgtcgtgaaaaacactcatgttc

SEQ ID NO: 637 - DNA, 1327 bp, Leptinotarsa decemlineata
  Annotation=Uncharacterized conserved protein; Tribolium gene name from OrthoDB database=TC014968; Blast E-value Tribolium Gene vs. Leptinotarsa Unigene=6E-64
gtacatgtttttgtgctcacatattttattaatcttcatttaataaagcttctctatttatcaattgttactttcattttcctcaaatatatttctcattatagtttcatacagaaatccaacgtttaacaaaggtacatggaataaaagttctatggacccatttctcttgaagcttttctctcaaagaattttttgacagcctcctcaaacttttctccaacagttctctttttccaaatatcaacttttggtttctttggcttcacctctattactttttcttcttcaccttttggaagaacttgtttctcctctttaactgaattttcattgggagacttatcatccgtagttttgaccttgggaacttctttggttttgttagatttttcttcttcattctcactatctgaagaatcaatgctgaaatccgagtccgcatctaagttagaagacaaatggccttttttcaccacaggttcatcttcactttcattttgggaatctctacgcgctctatattttcttttcttcaccgattctgttgatttgacttttaccctattgggttctgaaactttttcaggtatatgttctgacaaattactttcattcgctacattatcactttctggttcttctttgatttcttcttttattatcggcttttcgtccttctcttcataattcagtttttgatcatataaatgccgatagaaaccatctaaattgccttgcttgcgaacatctccaataccttcaagatattcctctcgtttttcttgctcttctagctctcgcatttcttctaacttctttttataggctgatgtgatgaaagattctttgtccttgaacatgtcaccttcttcttctcgttccttctgtacttgcctctcaattctcctttcattttccctttttcttttttccgcagtaaccaatagtttatttatatattttggttttctatctaaatctttcctagcaagttttgattgctttcgtttttggtccatctcatcaaaaatttcgtcatactggtaaactgttgggtcctcagtaactgctttttcttggttgattttatcctgcttttttagagttttagaggaacctgtcggtttgatatctggtgtatcagaatctgaatcaacaaaaatggaaggtctagctgttatttgtccaattttatgtcctttattaggaataatcaaaccatattgctttgccatatttctttcagcaagttacctttaccatccacttcaaaattcaaaatagaattaaacaatcataattattattattattattatgaatc

SEQ ID NO: 638 - DNA, 701 bp, Leptinotarsa decemlineata
  Annotation=39S ribosomal protein L13; Tribolium gene name from OrthoDB database=TC008947; Blast E-value Tribolium Gene vs. Leptinotarsa Unigene=7E-76
taatattttattatcgaagaacataatttttaggataatcaataattttcggaaattgtttgacttctttctcttggaaatgatccagtctctttggcattggtctcagttgccttaattgatttgaaacgttagccaataaactgctaggaacatttgcatccggaaaaggtgtagtcgagctatggtgtttcttctttgcaaattcttgttcagtttattataaactgctttccagagtaccattgttgggtccttgttatgcaactcccatgccaatgtccaagtagctccacccgggtatcctgtatgatgaaaatatactcttttcttccattcatccccaggtaaagcaatgtctgcagtatttataactataacatggtctccacaatcgttcattggatgataaataggtttatgagctcccatcaaataaattttcagataatctgcagaactgaggggattttgccaggctgcatcatatatatgccagatccgtgcaaatgtagcccattgttgaacccgtttcaaagcggacataactgttttaagttttacggggtatttcaaaaagaaataaaaattgagtaaatatacaagtaattgttacaagtttaatgtatcatttgtatttctatcggttttctttttatttcaatagggttatattgaggttagagatacagaactatctt

SEQ ID NO: 639 - DNA, 615 bp, Leptinotarsa decemlineata
  Annotation=Reversed polarity; Tribolium gene name from OrthoDB database=TC013309; Blast E-value Tribolium Gene vs. Leptinotarsa Unigene=6E-71
tacgagtacagtgtggtttcgtagacaaggagacaaaaaggagtgtgcagagttcaacacatacaatgcgctgctcaatttgtccgtgatgaatgacgacgtgaactgctttttagaaccaccttcaccgccttccaacttgaagagcttgagcgtgctttcgaacgcgccccctacccggacgtcttcgccagagaagagctcgccctcaaactgaacctcagcgagtcccgagttcaagtttggttccagaacagacgagccaagtggaggaagcgcgaaccaccccgcaagacaggctatatcagctccacgtcccccagctcaagcatcacaaccaacttcagtaatcccatacccttcacccagccgaacaccctcaccacctccgcgccagtggactcgtggagctaccagtcatcctacgacctaggctcccatctcaacctacttaacagcacgtccggctcgtactccagcttcggctctcctgcctcttattccagcttcggctctgcccaaaacagctacagctacatgctgaactcgcacgatagtcagctgttcaacgctcccatccgcgcgcacgagtactccacgccgccagccaatcac

SEQ ID NO: 640 - DNA, 1325 bp, Leptinotarsa decemlineata
  Annotation=Protein YIF1B; Tribolium gene name from OrthoDB database=TC010181; Blast E-value Tribolium Gene vs. Leptinotarsa Unigene=1E-147
gatatgtcatagtgacgtgtctgataacttttatgggttattttttgtgttgaaaagatgttgagatataaacttttcttatgaatttttaaagtaggctggcataatgaattataacgctaacagtggggggcgtcaaccccttacaagaaaactcaaaagagttacagatgtaaactccatgggattcaatccctatgatcaaggacaagggcctcagcctcagcaaaacatatatccaaatctggacccctcaaatttgcagcaacaacagaacttatatccaaatttgaatcagaataccccttttcaacaaggttttgccaatgttcagtttgactctttttcaagtaccccgaagatccctcagggccaacctccaaatttcagtcagaccccattttctattaatccaattggagcaacaaatttatcagttcttaatcaacctgttgttcaggacatggctcttcaatatggacagcagcttgcaggtgctggaaaaactatgttgaaaaatgaagtagagagatatcttcctgttacgaaactgaaatattattttgctgttgatactcattatgttttgtctaagttgttgttactattttttcccttcacacacaaggattggtccgtgaagtatgaacaagatggtcctgtgcaaccaagatttgaaataaatgtccctgacctctacattcccaccatggcatacataacttaccttttggtatctggtatcgttttgggaatgcaagagcgcttctctccagagcaaataggaatgttgtcttcttcggctctagcctggtgcatcgtagaactcgttgtctataaatgtaccttgtacatcatcaatgtagaaacaagcctacgaactctagatcttctagcttatgcaggatataagtttgtgggcatcatcaccagtatctcaataagcattttgggaggaagaactggctattattcttctctactatacacaaatttagctttatctttctttttggttaggagtctcaaggttcaggttttaacagaggcggttcaagacaccagttactatgggggaccgcagaccaccgctgggcataaacgtaggctttactttcttttatttttggctgcggttcaacctgttttatcttggtggctgtcataccatttgttacccaatgaaactcttgataaacaggtgaagtaatattgtgtaggcttttctggtttaacttattccttgtgcttctacatatttatgtcttaggtaataaataattttttaattcaagtgatgtaaaataaatattttttcaaaattt

SEQ ID NO: 641 - DNA, 835 bp, Leptinotarsa decemlineata
  Annotation=Putative prefoldin; Tribolium gene name from OrthoDB database=TC001098; Blast E-value Tribolium Gene vs. Leptinotarsa Unigene=4E-1; Blast E-value Tribolium Gene vs. Leptinotarsa Unigene=04
catctgaagagaaagttaatattatttattacttttgaagatccagttatcaaataatactacattttcggtaccaattgacaactcaaagtaaaatcatgttattatccaagttgttaatgaatttcaagcaaataattgttttatatgagaccaacaattaaatagattcattttgttgctgctttcaatgcttgtcttcttttaacatcccagttaaagactcttgccatattcacttcagttgtagtaaattgatcccttaaaaaatctaaatcatgttcaacatatcccaaatttcttgttgccgctgtaatgttttgcgtcaagagtttttttgcatcttccaaactgtattctaacatcacattagcacctaaccacaaatatactgtttctgtagcaggaactttggcttttgcgaaaacctgttcgctgagtaaaaattgagtttcgaattcttccttttcatcttcaagcttttcaatcatagtcagagaacgtttcagttcaggaacttgagtctgaagacgtttctttttggacagcaagttatattccatgaatttgtattttgcgtgttgactatctaattttttcaaaacttcatccacattcccattattgtctgatcttttcatgtaggtatctacatcttctacaaattctgcttcaggaattccagcataggatttcttgtcccccaattcagagtttgtttctatctccattcttcaaatgactaaaatatttaaacagagtactcaattttatttttaaacacttaaacgacaacaagaacgaaccaacagaactaaaatatgacaggaatccc

SEQ ID NO: 642 - DNA, 996 bp, Leptinotarsa decemlineata
  Annotation=Mitochondrial aminomethyltransferase; Tribolium gene name from OrthoDB database=TC015522; Blast E-value Tribolium Gene vs. Leptinotarsa Unigene=8E-152
tataacggcttcataaagtttatctcttattttcaaatgaactttagtgccgactttgctgttatcagatggaacataacccattgctatatttttaccgaggctgggtgagggacaccctgaagtaacttcacccaattccaggccattttcagataaaattcgagcaccttgtcttgctggtggacctgtctggtaagtcaaacctatccttttaaccgatgatccttctttgatttgtttaaggatgacttctgctccaggaaaattccccaattccctccttcttttagcaaccaaccaggttaaagccccttctacaggagttgttgaacttttgatgtcattaccatacagacaaagcccagcttccaatcttaaagaatctcttgctcctagtcctgcaagttttatattttcattttgcaataacgtttctgctactttaagtgtgtctgatgcaggaattgaaatttcaaatccgtcctcgccagtgtatccacatctagtgactctacaatctttgacgtctgcaataacaccagtaactgtattcataaaatataattgtgaaaggtcaacgtctgtgatgtctttcagaaccccggttgccttaggaccctgaagagcaagtaagcttcgttcgtgaggattgaaaaatttaatgtgtatgtctgcagatggatgactcttcttgaagttttcccatgctctcaacatatgtctttgatcatcttcttttcgagcagcatttgataccacgaataaatgatcgtctgaaattttggatacaataagatcatccaaaattcccccgttttcattggtgaatactgtgagactggctgaattatttttcaatccttgaatatctgccgtacatattgattcaaaataatctatgcatttagtgcctctgatttccgtttgtaacatatgagaaacatcaaaaagtgatgcacttttcttgtgaataagtgggaattaacaatactc

SEQ ID NO: 643 - DNA, 1753 bp, Leptinotarsa decemlineata
  Annotation=Ptc-related; Tribolium gene name from OrthoDB database=TC012361; Blast E-value Tribolium Gene vs. Leptinotarsa Unigene=2E-163
ctctcccttttatgaggaaacgatcattacaaagagaaaaactatcctgtctactattgctagtgtctacatcagtcaaaatcatatcaatcgacagaatcataacaaccatttcattttatttatataaaactttacatataaatatataaacagaaataaggtattttttccatttttgaaatattcaatacaacaattttttcaaaccatcgtaactatttccccctctcatacattagtatagatagggagattttttttttcagaacttccaaatacggataaactcattcaggaatttttctaaatatcgtatttctccgaagaaaatgatatattttcattatatttgatattactcgacttacatcatcctagaactgaaacaagtgtcaatttttttttgatttacgtaattcgccactagtcatatttctattccctttggacttgaacaggtcacattaaaacattcctactatgaaatccataaaaacaacaataacaccatgaaaatcactcattagttaattgaaaattacactaaggaaatctagattcctttatgaattttggatccttcacatacctaggatgtattatattatgataagagttggatctagcaatttgctctctgggatggtacctcgtttcagttggtgaatgctttgttttcgtctcgtatcgagaacgtacttgttctggtcttttctgctcgtacattcgtgtatttttcgcctccggtatcctctgtctttgcctgtaatattctgcttcggaatcatttccaaagatatccagcacctgtgatgaacggaactgatttatggcagcctcagaatttcgacgccaggcgtcgcggtaccttttctctaaagcagcgtcgtctgggggaggttttctttgtgaatgtacagatgattcgctggagttttcttctgacgtacccaggcctaaatctttttcgacgtcgggatagactttgaagggtttcttggcgtatctctctatacttggtatgttagatcctttcaaagctcctaaattgctaccatttagagtaaactgggggtgtggtatgcagtacggagaaggtagtgattcttctatggtggatagtttcatatcggaatcatcagtggatctcgaacacgatcctggtccaaacaaggacagtaacacgggaagcaaaaataatccatgcatcgcaccgaaaaagaccactaggaacaccattttgaaaaaaactgagaaaatataattgttggctaggtgcagagcaagcattcccaatatagtgctcacagatccttggaaaatgggaagtcctagtgcgtagagagattccttcactttttctttcggagttttggcttttgatgacatataagcatagcaaatatgggccgtaaagtcgacactgaatcctatacacataataagattgatcatggaaatagaatccaggttcactttccatagagccatatatcctacgactcctgcttctatagaaattatactgagcgctacccataaggagcacaaaatattgggaatgaagatgaaagacactaacatcattattccagcaccaatcaccatattctggatagatagaggtcgcaccaattcgaactggtcgaagaaaacgaaatatgggttgaacacggtaacattcagcggcgagtctctgcatatttttcttatagctctcaccatctctttctcgtgttcggttccggat

SEQ ID NO: 644 - DNA, 1240 bp, Leptinotarsa decemlineata
  Annotation=Uncharacterized conserved protein; Tribolium gene name from OrthoDB database=TC002727; Blast E-value Tribolium Gene vs. Leptinotarsa Unigene=4E-111
aggtcacacctgcctgcaaacttttctagtgtgatagtattagttgaaataaaacagaaaaagatgaatatacatttccactattattatttacgtaaactcgccctagatgaaaataaaatactataacgtaaataagtatatagtgtttttatctaactgcacttataatccatggaaatatccctgaaatcggaaatcattttatattcacttattagtatattcatccccaaaaaaatttaatatgtcgaatccaaaatcagcagaatctcgacaaagttttattgatgcgaaaccattccaaggaatgaatatcgctgataactctatattgaatatgctggaaggtcgacaaccttgtccaaaatgcggaaaatctaggaaattttattgttattcctgttatgtacccatagcagaattagaaggaaaattgccttttgtgaaacttcccattaaaattgatataataaaacacaaaaatgaaatagacggaaaaagcactgctggtcacgcagcaatattagctccagaagatgtctccatctacacctatccaaatataccggattatagaaatgaaaatgttgttctaatcttcccaagtcagcaggccatcaatgttagtcagttggtttctagtaacttaccgtacgattcaataaaggaatgtaaaaatgattctctggacgagatacctaaaggacaccatagaagtacgttgatgaaatatattccagaatcgagagaggattatgaattcaataggaccactaaagagttgcctatcagtaaagccatattcattgatagcacatggaatcagagtagaggtatttacaaagatgagcggataaagagcattccatgtgtggtaattcaaaacagaatatcccaattttggagacaccaaaaaggcagcccgagatggtatttatctaccattgaagctattcaccagtttctaatcgaagttcatttacattgttggggattgaacccgaattatagtggcattaaaaattgtgtcacagaaaagtgtttgagtcactttgaaggactgtatagtagtgaaagtcaggcttataatggacaatatgataacttgctgtatttttttcatcacatgtatgacttgatacataagtattatcaacacgaagacttgtatgcatataaaagaagattgttgtgaatgtctgtttttcaatacaacaccatcataaaattcgataga

SEQ ID NO: 645 - DNA, 1623 bp, Leptinotarsa decemlineata
  Annotation=Golgi resident protein GCP60; Tribolium gene name from OrthoDB database=TC007892; Blast E-value Tribolium Gene vs. Leptinotarsa Unigene=0
gtcataattatttacgatacgatggctactagccctgacgtttccaatgtattaaaagaaaatcgtaatatatcaacgcaacacgataatgggagtagtccacacaatgtactggaggaatcagccaaatatggtcttccactccaagaagtctataaactggcttttaatttctataaagaaaaagaaggaaaagcagtgcatttcagttacgaagacaaattgcaattagtggcattttcccaacaagtcctcaatggtccttacacagaggctgcacataaattacctccacttggaacattggatgtcgtcggtcgagatagaaggatatcttggcaaaaattagggcagatatcaaaagatcaggcaagagcaagctttgtggaattgctcagtagaaaatgtccattattttctacctatatagaagcgcatcgaagagagaagaaagaacaggacagaaaaattaaagaagaggaggcaagaaaacgaattgaagaggaagaaagactgaaaaaaatggaagaagagaaatatcttgaggaacaaatgttcaagcaagaagctatcaagcgacaaatacaacaggctttgaatgaacagacctttgatcagttccgaaaatattcagaacagcaataccctggagatccagagaagcagggaaatttgataaaacagttacaagaacaacattacattcagtacatgcaacaacttcaagctgctcagagagaacctctagataacaaaagtatcaatcagtcagacaaggaagatgttgatgaacggcccacacaggaaaactccgattcaaataacttgaaagatgaagactctgatgaacagagttttacaacagcaagtatgtggacgagatcagaaatagaggttttcaagcaaagtgtatcacaaggagaaggtgatggggttgttagagtaggccatggtgaaacggtgacagtaagggtcccaacccatcctcatggatctcggttgttctgggaatttgccaccgaccattatgatataggttttggtgtctactttgaatttggcacaccaacaacagaagaggtttcggtacatatatcagagagtgacgacgaagatttagaagaattagaagatgacgaggtatatgatgatgaaacaattcgcacaaatgacttggaatccggatcaatttctgtcaatggtgtttcaaaacctttactgcacgagatagttcctgtttatcgaagagattgccagagcgaggtttatgcgggatcacacccttatccaggcaaaggagtgtatctgctgaaattcgataattcgtactcactttggagatccaaaacactgtattacagagtttactacacacactagtaataacttattttatctgttaggtttttgctaagcgaaaaaaaaatttttttcatatgtttattggagttattgtttaaactgcgagcgtaccttaaaaattttatgattttgttcaaattgcacattatttgttttttggtttccaaattttattcatcaaagtcaatacaatctttatttttggatttttgtatatggaatttcctctactgattattaaaataattatttatattaatg

SEQ ID NO: 646 - DNA, 1275 bp, Leptinotarsa decemlineata
  Annotation=15 kDa selenoprotein, putative; Tribolium gene name from OrthoDB database=TC003269; Blast E-value Tribolium Gene vs. Leptinotarsa Unigene=8E-8; Blast E-value Tribolium Gene vs. Leptinotarsa Unigene=0
gatgtcaattcttgttttaaaataatttaatttttagttgttttgttcttgtgccactgttcaaagaaattcaaacacagactttaatttaatagttccaaaatatgtatatcgtgaaatcaatatttattattttattcgttaatttagtactagccgaattttctacagaagattgttggtccttgggtttacataaagccaatttactttgttcatcatgcgatcaattacctagattcaacttgacagaactaatgagtcattgtaaagaatgctgtcgtcaggatgatgtgggcccaacagaaaaaacatatcataaagctgttctggaagtctgcacctgcaaattcggagcataccctcaaatccaagcattcattaaaagtcaccggccttccctgtttccaaacttacaaatcaaatatgtaagaggcttagatcccatcatcaaactttatgataaggatggacatctgcaggagactgtagccattgaaaaatggaatactgattcagttgaggaattcttgaatactcacctggataaaattgatgatgaagactatttgagaacaaatatggtctgatgagctataaataagatattttcacatgtgatgtttattccacttttgaaaggaatagaagctgtctagataaacagtccatattagtatatcaaagtaaatgaaccaaaatatattgcctgattttcactggacagttaacaaaaatgcaacacattttgctatacaataacttcctcaatatcacggctgagaagaaagaagaagaaacataaaatccacattttgttccgattcacaccgaacttcaaagagttcctatcactgttatctgccctaaaaagttgatggaaacttagacactttttgatgaaggaagcacagttactttgacggacttcaaccttgctgaggagatgggaatggatggtgtaaatgatccattaaaaatgtattggaccaatgtacttcctatacagacgactatcaaaacgtgtcaatttgaaaattcagggaacgctcaatcaggaaatttttgacatgtcaaacgtaagaacagtttcaaatttgaacttcctgttcaatctgtagatgtcaaaaatttagcgacaacttggaatcatctgtcacgaattccattggtcaatctcaggaatgctaaccgctgattctgattggccaggaccacatcgatttaacaatagccagagatgttatacaggggcctcccaatgcacctgttatt

SEQ ID NO: 647 - DNA, 3594 bp, Leptinotarsa decemlineata
  Annotation=Nucleolar protein 6 E423Tribolium gene name from OrthoDB database=TC009293; Blast E-value Tribolium Gene vs. Leptinotarsa Unigene=0
gatataacctaaaactaaagtttaaaatgttccagttcccaagtttcattatagtaggatattatatttcagtataataatatccgttagcataagtgtaaaataaaactgaagcttcctgtgtgactgtgttgaaataaaatttgcaattatggaatcagatgagtatacagatgaaactgaaagtgatatctctggcagtggtgaggactctgaaaccgatactactaaggttaacaaaagttcaataaaaagaaaaaaaggagttgcaagtgaacatggattatcttccaaaaagaaaaaaagaagtgaactgtataaaccacccacagttgaagaattgaatagcttgaaggaaactgaaaatttgttcaacaataacttgtttagattacaaattcaggagttgctttccgaagttaacattaagaataaaaggcgaacgaatttattgtcatggatatcgtcttttgagcagttcttagatatgatgcctggttatgatgttttgctctccgatctgaagagcactaaaaaaaaaggagctctaggtaaactactcgcaaaactgtctgactacgaggaaatttatgagactgatcaagatgtattgcttaaacttgttaaacctgagtcgtttgaatgttttggattgtatgaatataattcattaccaggtccttatttgtcgatagatatcaatttgataatgcccacttgttgttttgttacaaaagattttcttaacaatcgttatttaactaaacgttattattatttgttatatattgctgagcatttaaaaaaatctgaattgactgcaactttgaacataaaattctgtgaagaaaatctcttaccacttattgaactcactacgaatacttgtgaaaaaacaataataacaatttatgtttcaccagctgatggaacttttaggcctgttagatttttacctgaacaaaacaatgttaagttgaatttattcaaattgaatatacctaatgaagttttaaggaatagtcctactatatattacaatagtgttatagcacatgatgcaactctacatgttaacatccagttcattaaggatactttgaaagatcaaagtaatcttcatgatggtatcaaactgctttgtatctggttgaaacagtatgaattgaataaagggaaaggttcatttacagaaaatttgattgtgtacataattgtttacttattttctaaacgaaaaataaataggttcatgagttcatatcaagttataagaaatttttggaattttattgcaagtactgatttacaaaatgaacctatcagcattgcaaatactacgtcagaagttctgaatagtttcaagaaatttttcaatgttgttattttagattgtacaggctgctataatgttgcatgttttttgaatttcgaagtatacaagaaaattaaagtagaatgtcagtcagcacttaaacttcttgatgataataaaacaaattcatttcagcagttgtttctcacaaagtatcccttctatctacaatatgacttggtaatagatttgacaaagtctctacctttagaaagtaaaatcagtaaaagtcatcaagaaaaggctttatatgtaggacatgaagaattattaacaactgatcatatgttgaaatttatccagaaagctatgaaagaaagggtacttctcacagtgcctagaatcgatttacatcaccgttctataaaacacttcttaattggtgtgaacttaaatccagacaaagcattcaattttcttgaattgggtcctgctttgagtgatcacaaatcagcagatgacttcagaaagttttggggacatctttctagtgacagaagatttagagatggtagcacaaatgtagcagtacatttcaaaaccaatacaatgaaaggaaaacgaaatataattaagaagatcttgcactacatatttaatgaaaaattggatgtaaaattcagtctgtactacgatgaactagaagatgtattactaagtaaaaacttgattccatcttatccctctggtacaaatgaagaaacttgtttgaagattatttgggcttgtgatgaacttggaaaaaagttgagatctcttcaaatgtcattgaaaattactgaagttcaaggaattggagatattttcagtttcacagaggcatttccaccaatccccgccaattataaggcagaacacagctcagcagtaaaaggaaacagtattgttttttccaatgagaatgtggacctggtgccccgttttatccaaccagttgagtgtgttatagaacttgaacacagttcaaagtggcccaatgatttagatgcgcttcgcgccatcaaagcatccttctacttagaaatgtcaaaaattcttaataaggaacatgtcataatatcacatccaaccgccgatttcattgatgttttatacgagggtttggtatttagatatcgcttgtatgttcccagagaaattggtttattgaaaaaagttgctgctgaaaatggtttgatatgtttcagagagtctgaggaaagttttgaaatcgagaaaattctgagaattatgccaagaattgttggtgctttgaaaggtatccagtcaatacatcccagttacggtccaggaaccgtcctcgtaaaaaggtggctgagagcccatttgattgacagttatcatatcccagatattgtgataaatcttctgaatgcatcattatatctcaacggtacttcccctccaaacactccacaaatatctttctttagatgtttgaaatttttatcagaattagactggaatctgaattcagttatagtcaacttcaacgaagaattgaccaatgaagagatttctgaattagaaagtaaattacaatgcaaccgtgaaagcaaacccctcttgtatattataacaccttatgatggaggtgcctctgttttcactaaatcatcgccttctagagaaattctacttagaatcaaacaactttctggagaaagtttagcgatcatgaataaggttacaatcgatcgagaagccatagatgtgaaaaaattatttgttccaaactttgaaggttataatgttttgatacatctcaggccgctattgaatccaagaagacatgaacaattatttgagaacctagaaagaacagttgtcgaaaaatataaggcatcaaaggatgataagctacctattgtgaatttcaatccagtggatatctatttaaggacattgagagagaattatggacaatttgcaatttttttccatgatagttatggtggaaatatagtgggtgtattgtggcgtccaaaagtctttgaaattgaagatttcaaagtgtctcgtgttaatgctggaaaaattattgaaggtaaaataaaattcaatatggatgctgttattgaagatttttatatattgggtaaaagtttggtaaaaactattgaaatcagatgatagtttcaataatctgagttagttgtattattgaatttttttttatagcaagtctaacttgtaatttattcaaggtttatattagt

SEQ ID NO: 648 - DNA, 1070 bp, Leptinotarsa decemlineata
  Annotation=Ca2+/calmodulin-dependent protein kinase; Tribolium gene name from OrthoDB database=TC010591; Blast E-value Tribolium Gene vs. Leptinotarsa Unigene=3E-86
aactagtcctagaaaagacttttatttatattgaaaactaaaaaatttgattctcaaaattaataacaactgatagtaagtagtctgaaaaaaatcagtcaataactaacagcaaatcttcccacatgttattgtcatgttggggataaaaaaagaaagtaacaattttgtaaacagccagagtttgtgaaatcaaaataataacatcaaatactaggtgtatctgtgattgctatgacacatatattttgggaattttagacaggcctttgtttagtgcactataagaatatcttgataacagaaaagcgagctggtataattcgaatattgcttgctttgtaggttttatatagtacttcaaaccaagttttttgtattgggcatgtttttctgctttctggagtaacttgtagtatctcatgtaaagagtatcttccaacaaaggcttctcaataagttctggtacagcaaagcctattttcaccaacttttcgcctacattcacgatgtattccttctgttgtttatctttttgtgtaaacaatacttgacattgaacataatttttatccttgctgattggtatgaatgtaactttctcatgtgacaatactgcttgcagccagttgcaccctagtccactaacattaattccagatattttaactggtagatgtcctgaagaaataaatggaacattgatcaatggtttgtgccttatcatcagtagtgtaccatgaggctctattctatccacaacacctacaagttcccttctctctctcaggaaatggttgggaatatccgaaggttttttaaatttactgaaagggcgaactttcctcacagccactgttaatccaacaagtgctacagaataacaaccgaactgtactccacgggtgttgttatccatgaaagtcgtaaagttgtgaaaagcgttggaaactttatccatcataactaaattcgttttattaaatcacatttaaaaataggtaaaaataaaaatatcttgaatacttgttatttatataagacgtttcgttttaagtcgctagatgtag

SEQ ID NO: 649 - DNA, 1309 bp, Leptinotarsa decemlineata
  Annotation=Syntaxin-16, putative; Tribolium gene name from OrthoDB database=TC009870; Blast E-value Tribolium Gene vs. Leptinotarsa Unigene=4E-135
tatctcatttaatattataccaaaagtaaattgagatcaaaattaatctgcatgttttcagctcaaaaatgttctacaaaacttgtttagtgaagaaaggatcgggaccaagatttgtcaaaaagatatgcattttaggacgataacgcatatttttactcacacttcgaatattgggaggcaggaaattattgattcaaaaacgaactttactttgataaataaataaaatcaccgagtttaatactttgcttaaaataaccatcttatatacagaaatgactaggttttgacaataatcagtataaaaaacagcatcacaatagtgccagcaagaacaatgatagcgcacatctttctgtttttctctgatatgcgtcggccttctgtagctgtttgaacccctcctgtacctgcatcgaagtctgctcgatgttgaagtcgattctgtccagcacagtaccttggtccaccaccatctggctcaagtctttgaaaatctcgttcagatccaggatggatttaacaatggcgtttacttcttgctcgtgctcctgggcatacctcgtgttctcctcttccaacatgagcagctgctgatgcgacatgggcttggaatttacgaagtgagagtcgatatcctccatgtcctgaccgttgaaatcctcgagatcgatattctggtcaaagtacatttttgatctgtcctctcttgactgaatctgccgcagatagccattttgggttgaacgaaataacgtcgacatttcttgcagagcgacagctagcgatgtgtagacattaactgtgagtcgcttttccttgggcactccctccgaagcatggcttttaattatttgcagcagccgatggcattcgttgaacatcctcgttatttcatgcgtacagttttcgatggcaacttcatcgtctgagctttcgtcgaatgttgacttgtgtaaatgtctggaatgcagggatttcaagtctgttattttggctttcagttttggaataatcatttgagccttttctaagtagtctatccatatcggaggcatcaagttctcgtttctagagtgtatgccatcttctaattcattcagagatactaagtgcattcgttctgaagaatcctgatcgggataaatgtttctacttctaatagcattgttcctcatcaacaggaacacatctgttaagcttctagtggccatttcaaaatttagatttgatatggaaaaatcactaacttctgttcagctcaacatatttgacgtttttcattttcaatgtttatgtttacgat

SEQ ID NO: 650 - DNA, 971 bp, Leptinotarsa decemlineata
  Annotation=O-glucosyltransferase rumi homolog; Tribolium gene name from OrthoDB database=TC013552; Blast E-value Tribolium Gene vs. Leptinotarsa Unigene=5E-164
attcatttcctacgtggaacactagggatttacacaggaggatgtgtttgaatcggaagctagcagcaacgccacggaagttgaaaaggtacttgtatttgcaatgatcctcaaacgatacttctttcgcaggtggggcatgaagagtgtctgcatctgacttccacgcttgattttttgtatatttggcatcaacaatcgatgaattttctcgagacaaaagtacaagaggatctctttcagcacttgttcgtgatcctctgaaaaatgcctttggtatcttttcgaaccaagatgaagaattaccaattgttcctagtttcatcctatgattatcccatctacctattcctctcggatacaagctaatagctggacctccttcccaaaatgaccaagctggatacataatatcgtagtagtcagatgttttactgaaggaaaaaacaggtccaaatataccataatttttgtgaatttgaggccaatctctggtgttcacaatgaactcaacatctggtaacttgggtaatagtttcagtaaaaaatattcaattcctgcacaacgagcgggaaacatgcagtttttttcacggaagagacggtttcctattatttgatatttggtaccctttgttttgactctttcaagatcctctttggatattccacctttgaaaactttcaaatcatctgcaataacatttgtatggcatgagcatttagattcattgcaagggatgtattctcccttcgcttcttccagcaactttaaataatggaaatgcttcgaatttgccccttctgagtatttgttgaatttctccaggtgctgtttgtggcaattttcatttttgtttaggcatgattggttttcagtaagttacttccaataccgacgaaaatgaaaataaacaactgacaaacaacgaatagaaacatggtacaacgttcaactattttatttattt

SEQ ID NO: 651 - DNA, 2263 bp, Leptinotarsa decemlineata
  Annotation=Zinc finger CCHC domain-containing protein 8; Tribolium gene name from OrthoDB database=TC014291; Blast E- value Tribolium Gene vs. Leptinotarsa Unigene=2E-98
ttcttaaaaataaatttattgattcaaaaagtaacataagggtgatttcaaaaagttttcttgtgtagtatttattttgacagtgacaaaaacgataaaaattttgatattagattcatcaattgtgactatgatttcatgtcgtcagtgttattttgatcacgcatgataacaaagtaatatttataaaattttttatacaaaaggttatttgtacatcttgttcacttttatttttcacaatatcatgatttgcagttttgcaaatgtttcattgtattccttactttctgcaaaacattcgtcatttgttcatacttacctgttgaattgggcaaattttcaaaatttataacagggctaacatctttcatgaaattttctgctttgggcaaacgtgagaaagaggaattgcttttgagaattggagttccaaaagaactatccttaacactattgaaactgatattgacaggaggtgatatttgacttgagctagaagtttctgatgactctttttcgatttggggagtatcatttcttgaaatttcttcagagggttctaggtctttactttctggaatattgatttcctcagaactgtctgatggtttgcggtctggtatttcacttgtattctcctccgacttgggattcgaacttgaattgtcattcagttctgctaaaagattttgttttgctttctctaaatccgtcagagaaggagaaggtgctccaacttcagttttcttgacatccagtacagcactaggtaaagatggtctgcaattcaaatcttctgttacatccatttctacagaggtttctatatccatatcatcattgtcattattatttacaacttggtttgcaaaatattccaacattactgttttgctgtacttttcagaataaggtggcacttggtgttgtctgaattcatctttcaaattttttgggatcggtacattgaatccagggtaatcgactattttgtcagaatttaatccttgacttctcccagaactaccttctttcacatgttttccttcagagtcaaacatcttcaaatttgaatgtataaattttgcttcttccaaccaccctggaggataacccaataatctcatttgataaatatacggaggtaactgattttttctcaaaccaagtgcctctctcagaccatcagaaatcttgcccggaaccaaatgactaaatttctgttcatcctctaaatggtaccgcgatacaagtttttgagccttgaattgttgtcttctaagatttattttgaaataatttttctgttctggacagtctttgagagcatggttttcatcgcagttaaaacaggtttgggctgaggctttaacagtatcttcttctacaatctcgttgatttcaatgttgaatttactggaatatttagcacaagaattatcattagttccactctgtggttgtgtatcaacaacaaagagatttttttctttttttggcttttttctcttcttagattttagaggggttggcggcaatggagaacataatttttcttcaacatctttcatcttggcaatatttgtatccataacttcatcaaccacaacccattcagtgggcaataatagaggatctcttttaactttgagagacaatttgtcttcactcgtaacttccaactctataaaggtttcaaggaatttcagaaattttaatttgtaaaaatctgacatgttttcattgctgaaagttatagtcaggcaattttccgaatcgagattgtttgttgcaggtagtggaggtctaggtgagcctgaattttcatcaacttctccttcttccaattctttattttgtaaaacttcagaaattgttggcaaaacatcatcactttcaattgattttggaacaggttcgtcagtttgtttgtcgagtttagtttctaaattattttcattttcgagtttagtgaatgcgagtactaccgaatcaacaaagtccgtttgagttttaatgagtttggattttggttgatcacaatcactgtcggaatggtctggtgacacatcgttatcgctgagttcaaagacagcactttttgaaggactttttcttttcatcactttattagtgtccatcgaattacaataatgctttaccctattttattttaaaatgaaatccgtcgattattgcttattatgcttattcgcattcgttatcgatttgacgtgatgactgttgacaagtacaaaat

SEQ ID NO: 652 - DNA, 1853 bp, Leptinotarsa decemlineata
  Annotation=ABC1 family protein; Tribolium gene name from OrthoDB database=TC008565; Blast E-value Tribolium Gene vs. Leptinotarsa Unigene=0
gattcgaaacataaccaaatactgacataagagtggattttggtttttgaagtcccaaatagaactaacggaaaatgtcaataatagtttcgtggcatgtgtacgggcttgggaaatgggaacatttttgttaaagtgtataataaatttaaacatctaacgaggtttataattaaaaaataagaattacttcattaacatagtgattgttgtattcctggagatgcttgttgaccttattgtgtacaactgttgcgatttttgttacaattactcaaaatgttccagatgaaattacgacctattttcaaatatacatttactgctgctgttattgggggcacagcactaagtttgagatctaaccaatatcagctagattctataggtattgtgagatttagcagagcagcttcaacagttttacaaataggaattatttatcaaaaagatttatatggaaaacgattggacaagaaaacaaaagaatataaagaactgaaatcaatttgccataaaagaagtgcagagaagttattaaatttgtgttgtaccaataaaggtgtttatatcaaagtagggcaacatattgcagcactagaatatttattacccacagagtatgttgaaactatgaaagttttgcactgccatgctcccacaaataaaatagaagaagtatataatgttattagggaagatttgaagaaggatccttttgaagtatttcaaagcatctatcctgaacctttgggtactgcctcccttgcgcaagttcacaaagctgtactgaaagatggtacaacagttgcagtaaaagtacaacatccctacgtacaaggcaactctagagtagatatgaaaacaatggagtatttagtaaaactgatgagttgggtctttccggagttcaaatttcaatggttagtcgatgaatcaaagaaaaatattccacaagaattaaattttgcccaagaaggtcacaatgctgaaaaaatagccaaaatgtttgaagatgtgccatggttgaagattccaaaagttagatgggacttgacaactcctagagtgcttaccatggacttcgtagaagggggcaggttaatgatctgaattacatcagagagaataaaatagatcccattgaaatatctgataaattgggacagttatattcaaagatgatttttattcatggtttcgtacacagtgatcctcatcctgggaatattctggtaaaaaaatctgagaaaggacgttgtgatattgttttgttggatcatggattatatgcgaacctgaaggatgaatttcgagtagagtatgcaaacttatggttgagcattctaaacagagaccgtaaagccatgagggagcactgtcgaaatttgggtatagatggtgatgcatatggattgtttacatgcatgatcacaggaagaacctgggacagcattgttagaggtattgataaggagcagctgtctaaaaacgaagtgaaattcatgaaacagacttttactggaattcttccacaaatatctgaaattctacaaaacgttaacccacaaatgctgttagtttttaaaaccaatgacttgatcagaggtattgaacacagtttgcaaactggggctcgcatgggagcgtttcgtgtgatgtcagagtactgtgtcaaatcagtgtacaaccaacgatacagaagatcggaaaataagctggaatcaatgagaatctcgatattacagttctgggctctactcaaaattaacatgtattacacctttttgaatttgaagcagctctctagaaatattctcagctgataagctgaaatcgcacaggtttactgc

SEQ ID NO: 653 - DNA, 1152 bp, Leptinotarsa decemlineata
  Annotation=Proteasome subunit alpha type-2; Tribolium gene name from OrthoDB database=TC004868; Blast E-value Tribolium Gene vs. Leptinotarsa Unigene=1E-154
gagttgcaagtaatcatggcttcggagcggtatagtttttcgctgacaactttcagtccatctggaaaactagttcaaattgaatatgccctagctgctgtagccgctggagctccttctgtgggcattaaagcttcaaatggtgtagttatcgccacagaaaacaaacataagtcgatcctctatgaagaacacagtgttcataaagttgaaatgattacaaaacatataggaatgatatattctggtatgggacctgattatcgcttgttagtgaaacaagctcgtaaaatggcccaacagtattatctagtttatcaagagcctataccaacagttcaactcgttcaacgagttgccactgttatgcaagaatatactcagtccggaggagttaggccgtttggggtttcattattgatatgtggttgggacagtgaacgaccatacttatttcaatgtgatccatcaggagcttattttgcctggaaagctactgccatgggcaagaatttcatcaatggaaaaacatttttggaaaaaagatatagcgaggatttggaacttgatgacgcagtacacacagcaattctgacgttgaaggagagttttgaaggccaaatgacagcggacaacattgaagtgggaatttgtgatgaagcaggattcaggaggctagatccctctcatgtgaaggattacctagctaatattccataaggcatttaggttatataacaagatttctcttaattttttatgaaactcatgtttcacttgaataaaaccggatttgaaggaaatatatgtgtaatttatcctataatagttgcaataaattaatagatgaaaaagaaaaccataacaatctaaggcgaccttagagactatagtaattactgccaaaataaggtctgttagctctttagtgatgatgttgaacattaattttgtaaagaaaggttggttgagtaactggaacaaatttttcttatgaattgaactgtggaagctgtcacaaatgctatgttggataaaccggacagtatcctaaaacacgagtttcagaacacatgagagactcgaagaaactaaatattaaaaaacctcgcattcctcgttgaaaatgaaaaaagaatatggacacatttt

SEQ ID NO: 654 - DNA, 1535 bp, Leptinotarsa decemlineata
  Annotation=DNA-directed RNA polymerase III subunit RPC1; Tribolium gene name from OrthoDB database=TC010530; Blast E- value Tribolium Gene vs. Leptinotarsa Unigene=9E-56
tattctaacgtctagtagttttttttttttttttttttttttggttagatgtaaatataattaatcaataggcaaaacaattatgaatattcactttatcttttatatgatataaatttacaaataacacaagtttttttaaagaaagctgttattaaaaaatagtagattgaaacacctagacattttttcatgatctgatttgaactattgaattttaatgcattatatgaaataacctataaaaatattattattacctttacaagttgttcacttcatcaggttgtatttgtttatcgttaaagtagattgaaataacagttttcatgtattattttattattacatttcaattctgttcactttttcacaaaatgaatgtctgaacctcaaatattgaatatcattttcaacattgttgctgttgtatcaataaatactttttttttgcaaaacacttttaaaatgttatacttgaaccttctttcatttaaaatttctagagtaattaacaactcttgcgttaaatcacaatggctgcaaatatccctatacaaaataattaattcaacttttttctttctttagggagacgataatgtctgaaatcaaaatggttatggaaaaccatggaatgagtgttgattacaggcacataatgttattagcagcacaaatgacacatgttggcgaagtactaggaattacaagacaagggctagcaaaaatgaaacagtctgtcctcaatttagcttcggtaacttctccaaataaactcattatattcaaaacttaaatttgattttccttttcagttcgagaagacagcagatcatttatttgatgcagcctaccatggacaaacagataaaatgagtggtgtttctgaaaacatcataatgggtatgcaagctcctattggaacaggaatattcaaattactccataaaccacttcacgtagaaccaaatcctgagccacaatgtcttctgttcgaaaatgtgatacaggaaaatttgtaattttaaatgtttattcttgttaagatatataagttatatagaattatgtgacaaaataaaaaataaaaactgcttcaaggttattttttagattgtactaattctcttaaactatctgttgcttcttttagagaattttcgaggaaagttttgttgctttccaacactttaattttgtcttctgctacattttgcttagtcttcaaattttcctttactttttcaatgggagttagaaaaaacattcttcctacagattcatatgtgtttgtgccttcttcaatagcattgatttccctctctgtaattgatgcatgctgtttactccttttcaaattttctatttgtatgtctgccatccttaatttttgtgtagtttctaattgtttttcttgtaactcagcgaaagcttttttcaactccatatccactttagacatcttaaatttttgaatgatatttcactattcaatgaaacattccatctaactttctaaccaaattggattc

SEQ ID NO: 655 - DNA, 506 bp, Leptinotarsa decemlineata
  Annotation=Forkhead box protein F1; Tribolium gene name from OrthoDB database=TC015957; Blast E-value Tribolium Gene vs. Leptinotarsa Unigene=1E-28
gaatcacactagtgttattttatcgaacgaccaaccgcagacgtcaacacaacatgtatctccggaaacgacaacccaggaccctgacacgaagccttccagttctgacaaaaaatctggaatacgccgacaagaaaaaccaccgtattcctacatagcgttgatagtgatggccattcaacattctccaactaaaaggctgacgcttagtgaaatatacacgtttctgcagcaaaggtttccgttttttcgtggctcctaccagggttggaaaaattcagtgcggcataatttatctttgaacgagtgtttcatcaagctgcccaaaggactagggaggccgggtaagggacactattggacaatcgaccctgccagtgagttcatgtttgaagagggctctttcagaaggcggcccagaggtttccggagaaaatgccaagctatgaaaccgcagtaccatccgggaacattcttcacaaataatatggctgggatggtaaacc

SEQ ID NO: 656 - DNA, 2467 bp, Leptinotarsa decemlineata
  Annotation=Tumor necrosis factor induced protein; Tribolium gene name from OrthoDB database=TC004961; Blast E-value Tribolium Gene vs. Leptinotarsa Unigene=5E-87
tcctcactgccgaacttcttgcctaaatatcatgactacaatggtggagctcgaaagctggctgatttatcaatatgtgactaccgaatgtagcaattgcttgtgaccgttgggtggctttttatttctctcggaaaggtcttaaatgttggatacaattatgatggaaagtgctttcaaagccagggatatagggctgagagctcagaagaaaattctctctcgcatggcagggaagaatatcgccaaggttttcattgatgacgctacatcttcacttctagacaacttataccgtcttgcaaaacaatattcaaacaacaagaaagaagccgaaaaattaatcaagaacatcataaaagtggtgataaaactgggtgttttgcatcgaaacaatatgttgtcagaagaagagataaaacaagcggaaaagttcaaagcgaaatttcgtattgcaggaatggccatcatttcattttatgaggttgatttcagctatgaccgcaattatattgtacaagctctaaatgaaagccagaagtgccttgaaattatagtatcaaaacatttgacagataagtctctttcacgaattgaaagtgtcttctcattcttcggaaatgatcaattcctggatgcaatgttcaaaagggattcagagtacagagaagcactcggcagagttgtgagtgatctcaataaagccatcgagaatggagatctttagtccttctacttgtgatttatatgtgattgttttgtattatgtaggtatttgtgaatttttttaaagtttccatttatgttacttagatatatagaaaaatattttttcttcagcacgaaatgaatcataatgcattgataaaaggacagacatattcgtcagaatttgagtagcacttgagaacattaacgttaattgttcaccttttaataattctctacgattcaaaattagtagcaatattatttcgaatatgctcaaaattgtttattgaggttgataataaaaatggcgtgtacatatgaaagatataacatatcttgatttacgttattgttgcatgaatatttagaaatagaatatttttgcactggaacatataaaatttctaaaattgtcctaagagcaactctctttaagtaccttctaacttaaaaagtttaaatttacactcaagttcaaagaattctcttaggttttacgaaataatttgcttaaataattaggatattaactgactgaattcatatatctaccacatgacagatattatactatatttatttataaattcaccaaaattattcattaagagacatcatgacatggtattaatggatataattccataatcagtatgtataatcaataatctacttcttattgtttaacgaaatattgtcttgccgaaactaatggttatattcaaatttctagactatttctgtaaggccaactatttttgacccaaagaaaaatcgaaagtgacttcataattcagaattgacaaaattttccaaaagttaataatctgtaacatcaaagagattgattgaacaattgacaaaaagatatttcaataaaaaagaggtaagagaagtcaaaatggcaatgcacttccaagcacatctttgtttttggggcttgttttacataaattcaagagaagtgagtattattctatactagcataagaatgctatcattttgaatgtcaaaattatcagtcactcttgcattcctgcacctctttaattcaacagaaaatttcgaatggaccaatagatggtgaatttaagatatagactatgaaaattagcaaaatctccttttgtagatggaaacatgcagccttaattaccattagcattaacattatcttccaaaagttgaaatattgcttttgccattccatgtcatgcagcatgaaacaattcaattttacatttattaggtcaacttcttaatgttctgtgcttgcttctgcacacatttcaatgaaatcttgtgttttgtcgttctatgtcgtctctgtcagacatattcatttgtgaacatttgaaggatgttaaatttgatatgcccaccagaaatcttattccaaaagactatttacttgagtactgagatttaaatcattgtcgaaaattgtccattaatataacatgtcaaagcgaatacgcatgagcaaatatttcttcattatggtgcatgcaaaatattttaatttttcttaatgaaaatttaaattagactgctgtgttttgatttgtacgtgtttctcgataagtgattcttgactattaaatttatggatgtttaagtttttccaaatatccatgcggtttcccttattgacttgttatgagttttatgttctctggtgggggaaagttatgtttgttttgtatgacgtgtgttgcgaggtttcatttatatactattgggtttatgtatatc

SEQ ID NO: 657 - DNA, 1827 bp, Leptinotarsa decemlineata
  Annotation=Inverted repeat-binding protein; Tribolium gene name from OrthoDB database=TC009971; Blast E-value Tribolium Gene vs. Leptinotarsa Unigene=9E-129
gtacatcttgtaatgcattcattcaacatgttgaatgccgcctttatgtaaaggttgttttggaaaataaagacacgctatttttattattatacaattgaaaaaaatatgttatttcaaaccaactttatttgatatgctggtaacatcacttccgtctcttctgggaaggccctttttgagcaggagcttttctttttttctcgcccgacaaactgaatgtactgtggatttcttcaacaacctccctcaagtgactatccagtgtgtctctatcgaaggctacatcatttacttcttcgattggctcatccagtaattttgatttgacataagctcttcttttttgaaataatacatctggcaccatttttaaatcaaaatcgaaagtcattttgtcaaccaggttctgtatcgatattctttgcttttcgtctgctactctctcagggtattcttgtttcagagggtaacttatttcattcgcaaatggtaaacctttcaccaaaaacataggtgaaccatctactttaactggaatgagttcgtcgtatcgaaccttaccaccctggctcagtttcaacatacacacaagtactttattcatatccacacagctttgccagaattttttaaagtaaggcaaatcttctttgggatcttccttaagtaaaaaagactttgttaaaacatgacccacgtctacgactctatccgaaacgtacaacaatgtaattccttttggtagagagtaatccaaacaagcttccttttcagaaagtgtgaactgagcactatctgctcggtcacaatcctttattctgaaacgataggacgtattgtcatcgaactcaacagtatggtttattacttttttaccatccttggtgaccatgatattgttatgagatgatgaaaacatatattcctctttcaaacattttataaagcgggttggatcatctttgaaagggtagaaatttaaatgtttgttattcttcattaccactgatgcagataacttttgcacaagcccatcagtatcgatgcaaatttcttcaactcgtggtcctcctattaatgagaagagctcattgtaaaacaacttgtaattgaagttttcaactgttggtacgacttcaaattcaatttgattgcctccaaagttttttgcctcgttcaaagcagtgaatttggtatttttgtttttcactgggttatcatcgtttgttatgtatattagggttcttttgtaataggtcgttttaatttcgtgaaaaagcttcttgcaacttaagaaaaaagtgcccaaatctaactctttctgtctctgaaactctttcacaatttcatcatctttcaattgtgtttttgctttcaacaatttgactgaatcaagtatattatgctgaaaattaataagtgcagtctgttctccagctaacactatagaaaaaggactccaagttcttttatctgatttgaaaatgagagaatcggccaaggcgtagcaagcttcaagacaactccgaaaatgtaattttccttctttatttgctttgaacattgatgagtgggtatcaatggcgataacaacataggaaggtgtaaatgatttctcaaacacttcagaatctccttcttcatagtcactttcttcctcgtcctcgttcttccacatcttttataaaagtgcccgttaaaacaaactcaaactttaaaaatccggctgtcacctattgaatcgatacgcgctacccgctatccgctatcaccgtacataagtaaacagtgtttacttctatacggtcacagaacacctgtagt

SEQ ID NO: 658 - DNA, 2750 bp, Leptinotarsa decemlineata
  Annotation=Zinc finger FYVE domain-containing protein 28; Tribolium gene name from OrthoDB database=TC011751; Blast E- value Tribolium Gene vs. Leptinotarsa Unigene=0
gagaacatgatttgttaagtcaaactttcttttattagattatctattataagttattctacaacaaaagcaaacattcttcataaacattattaattcagtcaccggaatttactgaattcaataagaaactggtaataattttttaaagatgtcaccatggaactttcacgtgctccagtttatgaatcaaaaacaattttataaattctatttgaacaatatggaaaagttatgtttgtgataatcctattgtgaagtaatgtggtatgatggaatccattcgaaagtggttgtataaacctaagaaagatgacaagtcactattggcacaatttttttatgctgatgaagatctcaacattgtcgccaatgagttagatagttttgacggtagaaaggacccggaaagatgcaccaccttagtcaatcaattgcggcaggcacaagacaaagtattaacaattaccaattccatcatggacgttttgattggagacgaaagggccgacagagattttagggtcaaatttcctgaagatgtgctccaggacaatcttgctggccaattgtggtttggggcagagtgcctggccgctggttcatcgattatgaatagggaatcagaaagtactgtgatgcgaccattggcgaaagcagtgacaaaaagtctagaaaacgtgagaaaccttcttagagatgcgtgtcttcgaaacaacactccgaacggcccaataaagctcgattccaatgagcttgttactgaaatgctactagagagcctcaaaatattcgacagactctttgctgaattcgaattagcatatgtgagtgccatggtgcctgtaaaatcaactctggagtatgagttgcaagagctcataggggttctgttttcagaaaccttgcagagagctctgaaaatgaaacttttgacccaagaaatggtggacgactgtgatcctgctttaatgttcaccattcctcgtctagctattgtcagtggccttctaatttttccaaatggacctttattcattgacaaacctgtcgaagaaatgagtgaaatgttccgacctttccgaactcttttgcataaaattcgggaattgctgtggattttgaacaaaagagaattgtatatgttggaaaaattattatgtgataacgaacagattagtgacttaaaatcggttagtaatgtaggtgttgatagcaatttggatgattttattaaccaattttatactgattaccatctttgtgaagactctcttttaaattctgtttcgacaagtgccaataatgttggaagtgctactaaacaagaaagtgttcaaaagtctcctcaacgaaattatgccaacatcatagatataccctcaacttctggacatttgatacctaaaactgtgttccatcacaccatcatcgcagcatcatctgtgtctccttctcacagaatccgacatgaatcacctcctgatcatgactcattggaagtgatttcggtagcggctgccacactttcttccattctcactactactgatgtactgtccaatcagaaagattcaaaacccacgacacatcttgaagaccttgaatctcccaatgactccggtatttgtactgaaactaccagtttggacagatctcctagcttggagctgaacgagtctaaaaagtgcaattgttctggtaactttgcttcggcaacttgtccttgtaaaaaatctgcacatcagcggcccgtcatagttgtcaagaattcactacgagcaaaatcttgccactcaccgggaacaagcaattcatcatcgttttctatgaataagaagaaaatgaatgatagggctgcaagtggaataacagatgaagattctccaagctcagaaagctctgaaacttcctctttccacagcatttgtgctgatgatgaagaaatagcgctcgccatgcaagctgctgagttggctagtaggaatgaagttagagcaaaattcaggtcgagtgaagatctacttcatcggttatttgtctgtattgctggtgtggcagatcagcttcaaacaaattttgcttgtgacctgagaaatattttgaaatcagtttttttgatcaacacatctagtcctgagtcagcaaaaactctcgaatctcccagtttagacgtctctattgaatatcacccacctgaaggagatgttattgaaaatcatgaattttctgttgaccccaatattctggcccaagaagctttattcgacactaatgttttctttcatctggattcagaagagtgtccttcagaatattccaaccaccccaggcaacttcaaagtgatgagcgcagtttaagttctttatcttcagacctgaataggtatgcatccttacgagaggatattgctaacttggcaaccagcatcatttcccaagctaacgaaaccaatggcagtagggaacagtacgaggaacatgacttctcgcgacctcccgtctggatccccgacgttgaagcccctaaatgtatgagttgtggagccaacttcactgttgtgaaacgtcggcaccattgcagaaattgcggaaaggtattttgtgccagatgttcgtccaatagtgttccgctccctaagtttggtcacataaagcctgttagagtgtgtaataaatgtttcatatacaacttaacccctttcacgatgtaagggttaaggttgttcaataatgtacttaactttaag

SEQ ID NO: 659 - DNA, 3298 bp, Leptinotarsa decemlineata
  Annotation=Secreted protein; Tribolium gene name from OrthoDB database=TC004720; Blast E-value Tribolium Gene vs. Leptinotarsa Unigene=1E-1; Blast E-value Tribolium Gene vs. Leptinotarsa Unigene=01
tttccgtgttccaatctgtatatactttggctctgtgaactgaaaagtgaaacataaccaaacattacaagtaggaatgatattctttttctgaatttccttgtgaaaaacagtcagttttgtaaaccttttagttttaccagaaacatattatggaggaggctctagattctagaaagcagtatctaattctaaatgtggtcaactttttacaagatgagttgataaatggcaatctcaatgatgagagaaaagaatctgtggaagttgccatacagtgccttgaaacagctttcgaattggacacggaagtcagatccagtttgggtaaagacaaagtggacttgctttcactcattcccttcaacaaaaagctggtggtaactgaagaggctgccaaagaagctgaggagagcaaaaacaaaggaaatgcttacatgaaaaattcgtcttataatgaagctttagaagaatatacaagggcaattcaattgaacccaacaaatgctgtttactattgtaaccgcgccgctgcctacagtagactagagaaacacttagaagcaatcaaagactgccagatagcaataaccctagacccaaattacggcaaagcatatggtcgtcttggaattgcttattccaatctcaacaggtttgaggatgcaaggcatgcatataaaacagctctggaacatgaccctggaaatgccatgtacgaaactaatatgagattggctgaagagaaactatattccaatatggaaaatgcagcacccccggaacacagacctgtggatattactcaatttatcaacaatccaaatttgataaacatggctacacaaatgttaggtgatacaaacttccgaggcttaatatccaggttcatggaaatgagtcaatcaggagaccccaacatagatgcattatttcaagctgggcaaagtttagcttcaagaatgcagacagtagatccaagctttgtagagaatttacgaaggtcattagatccagaaaatataacttctcaggataatgttagtaatgttaacaatagttcagaagataccgaaaaaaaatcagaatagaccattatcactcattttttgtttatagttttgttgttttattttgttggtgttttatgttgtgtatcaatcagctacagcaaatgttttgtcattcaattttatattgtgactgttgtctacaaaagtgtgtatcactatattgaactcttaactatgtcacaaagacatgaaagttaatgaattttggacctattcgtgataactaaatcacctctttctcatacatcactaatataaattgaaaggggtttatttttgaagaagttaatttttgggaaagaaaggttttagctttctacttctccatcttgaaatcaaaaaatgtgggaatcttccaaagaaaggaaagaagcaatcaatttcaaaaaactaactttatataaagatgtgtagatcatgcaaagtagtaactttcagacacaaactggaagaaaaacagatctccaaatattaggtttacatatgaaattgaaaacaacgaggcattaccattcttggatatattagtgaatagaagaatccagagtctagagtttgatttctataggaagaataccagtactttcagctaatagctcataccattgtacacaacacaaaatgacaggtctaaacttccttgtccatagcttgttgcgttcccatgggtaaagaaagatatgatattgaaaaaaatatcagaaacatatctgatgggtattcttcaaatataatagatattttatttaggaaaagtatataaatttagggaaattttttgtacagtgacttttcaaatagatatagattcaaagttcattgttctttcgtatgaaccaagatacactaatgcttagttgaacgtgaaagaagtgttcaaaaattcttgtatatttcaacaaatgtttggaaaccctaaagacaagatgttcgaaaatgaaaattcggggatatatgaaattagctgaggattgacaaaaaatatatatagcgatccattgaaattcgttttaaaggacacatagcacatatccgatttcggagaccagaaaaatctagtttcgctcaacacagtttggaaaccggccatagcataaaagaaaactgtatgaaactgacatcagttcaagacactaaatttttggatgctttcgaaagcctagaaataatgtgacatgagaactatgaacagtgacaaaggttccattccaaacagtccattgttcacctctatgtgaattactctgttgaaattagatgtttctttcacgagaaaatttcccgcgactttctacccgaaattattgacgtttgtcggaaagtaaaagtgtctctgttagatataaatagatcagttttagagtaaggaattactttacttcatctcctgaagtagccaacttggttggtgaaatgagcgtcgagaagagtgcagttcttttgtttatttgctttggcgccttgtttttacagcaattcatattttgattcaaatcacgattaaaattgaaaaaagcaaccacaaaagtatatgtcattttttctaaatatcatactcggatatacagtttgggtgagtacgaaagtttttctgggtgtgtataaaattatattttcataaatatttttattgtagccctgaagatgacgatatacatcgctgaaacattgataactaaattgtaagtaaatgagtgactttgagtttgagaataagcatgatttattgtaaaatactcagatttctaacttctaattgatgaaaaggaatgtgtcagtataatttgtatactggtgatgtatgcgaaagagatgaattcaatgtaggaagaattgggtgaagtgatgtttcttctcaaatctttttctttctatgtcgaattgttgttactttttcatattgttgagatttagataaattcaagattctataacttttgaattggtgtgaaaggtacacttttcactgaaacgataattcaccatggagagaattcaaagtagtaacgtggcattacaatttcactatggaaaattagttatagaagattaatttagttttatgtgtttttttttcaaatattgtcgttatttggtatgccaggtctttggattttcaagatggaaagtttaagtaatacttatctgaagaataatattatatcctctatgatatatgatgtaaacaaatggatttattcttattaaacaagacattagtaaaa

SEQ ID NO: 660 - DNA, 1451 bp, Leptinotarsa decemlineata
  Annotation=DCN1-like protein 4; Tribolium gene name from OrthoDB database=TC011556; Blast E-value Tribolium Gene vs. Leptinotarsa Unigene=6E-134
gaatctcgtagctgtcatagtgtcaagtgctcgttgtcatcgtcacagacgtcaaagtgttgtgtgttttgctctgtttttgccccttcctctccgctgtagacttgattacaaaaaagtactaaaccaacggatccgcaggcagcgtttatcatacagctgatgaaaaatttaaaataaatgtaatataatttatcttctacctaatgcagcattgttaatccttcgaccttttcaaaagtgctagacctcatcttttgtattgaattcatttccctaatttcgtgcataatatccatgttggggaggggttataattaataccaatatttgaccgtggttacgcctgatatcccgaaagaagaacataggctgtgaagtttgcaatgcctcgtagcaaacgtaggtcagcagaaatgagttcaaacgatgaggataggtatagttcaaagagagtgcgaagccagaacagttcccgaagaacgtcgagaccagaggagcccctgtcgtatagtcataagaaatgcctgacgtggttcagggagtacacgacacctgacgaaccagacacgctgggtcctgaaggaatggaaaagttttgcgaggacattggcgtcgaacccgaaaacgttgtcatgttagttttagcgtataaaatgcaagcccggcggatgggttatttcacaaaagaggaatggctcaagggactccaagagctgcactgcgattccattcaaaaattgcaatgccgtttagaaagcctgaagtgttatttgaacgatcaaaccgttttcaaagctatttatagatatgcgtacgattttgctagggataaagaccaaagaagtatggacatagaaacggcgttggcgatgcttcaacttctattaggaagaacctggcccctacacgcccagtttagtcagtttctcaatcggtctaaatacaaagtgataaacaaagatcagtggtgtaatattttggagttttcgaggacgatatataacgatttatctaattacgatgtagacggagcgtggcccgtaatgctagacgaattcgtcgagtggatgagaatgacgcgagccaatagcgacataagctgagattcactaggaccaactataactcaccctgtaaattttaattttcgtgaaggtagggcgtaaacgccgcattttcacaaaaaataaataatttttaaaagtcacaccaaccggtatggacgtaagtccgctcgtactttgttattggcggtgtggaatggatgcaaatcggggaaaaattccgagtatacttttttgaaggaccatatctgttgctagattacaagtaactgatttccgttcatcgtacatcgctacatccggattcaactaagctttaatttcatcaattctattacagtaacttcggaggatgctcctgccatacaaacaataaatgttatg

SEQ ID NO: 661 - DNA, 2127 bp, Leptinotarsa decemlineata
  Annotation=Transcription initiation factor TFIID subunit 6; Tribolium gene name from OrthoDB database=TC013033; Blast E- value Tribolium Gene vs. Leptinotarsa Unigene=0
ttttttttttttttgtacgatagactttaataaagtatgaaaaacatttatatttgtaaaacagtaacgaaattttctatatcactcgctaataattacactaaatgggaaagatcgtcaagagtagcaggttgaagttggtgttgttgttgatgttgttgctgctgatgctgttgctgctggtgttgttgctgctggtgttgttgctgaatagcataattctgtttagaaattaataaggcaggtggttgtccaccggaattctgtccttggaaattagactgattggattgattagacactaccattaatttctgcggagttgaaattttctgttgactattggggttgtttggcatgaatttgaccacagtattttgtgaaggtgtagactgctgattctggtgagaagtgcccattgtgctctgaggtctttgagttacatacacaaacttttgattttgttgtgggttttgaactctaggtgttggattcatcacaattgtccttccagcagtagggttttgctgttgaataatgccactcagtgttgtaacggttcttgtgatagatgaactacaagttattggactagtagtcatacttgaaggaacggtagtaactgggtttggctgggttctggctttaatgacagcagcatgcagagctattcccaaataaccgtactcttgcctatactcctccaagttatcaggtggaccccgtatagtcttcaagactggtgccagcacttttactagtaactgttttatgtggccagatgctatcctgtctatattagagatgagatttccttctagatgtgattcaacacgagcacctatggctttgatttttggaagaataaatattctggtcacttcagtgcccaattctgagagtccttgaagagctccatacagagaggatagtggaaccttatcttgttgtaaggcatttgtaaacattctggtcactcttgtctgaatattattagtacttgtattgaaatttttacaaatttgagccataagtcttgatgcaaaatctcttagtgcccagtgattatctaattcaggtctcatacaaagttgttttgatacaatacaggttgttactgatggtatcaattcgtgaagatatttctccaaatacaaggattgattatctaatattgcttttaccattctcattagatatatcaaaagtgctaaattattctgaaccacatttactcttacaccttctatgataaaagtgcacattcgaggtagcatttcatggagtcctggatcagatgcaagactttgcagagcttctgctcttctagcttcatcagagccaacacaggcctcagttatttccttgtaatacagctgttgttctacagatagttcatgtgtggcaagttgcttaatttgaaccgtttcaacatttcgtaatttttgtttaccagtagttggtttgcctgaagtttcttttacaggctttttattgactggatccacagactctaatttctgggcattttttgctacaggcggtggattttcagggattgttggttggacaccatcaatacataaccaatgagacctcagtgtacattcaagtggggcctttggattcgtattttgtagtaaatcattcaggtcaacctctttttcttcaatgaaatgtagttcccttcctcccccagatgcaaaccgaaagggtaatggttctgatgattggaagccatactgaggctcaatgttctttgcctttagagctgcatctacatcactttgcataagttttatacgtttagcatgattcatgaatttggctgcatcttgaattatatgttttaatcgaaatgatatatcttcagcaagctcctttgcagcatcatcagccaaatatcctatacctatactttctgctataactttcatagactctattgagaaattagtgccatacaaatcatggtcacttattttcgacattatacactctccttgtctgacttatttcatacaatcaattgttataacaataattctcattcaactcttaaaacccttattttccgtgacatctctagtagtaactacctctcgcgtctcgcacacttcgtaaacc

SEQ ID NO: 662 - DNA, 3239 bp, Leptinotarsa decemlineata
  Annotation=Xe7, isoform A; Tribolium gene name from OrthoDB database=TC002060; Blast E-value Tribolium Gene vs. Leptinotarsa Unigene=5E-13; Blast E-value Tribolium Gene vs. Leptinotarsa Unigene=0
aaaagcaatcattcctctcgggcgatttttgaccaggagcgacctttctactcttccttaggtaagagacagactttgaacgatctctcgcagcagatctttgttccgaaagttgctttggagtcaaaaaaagtagagctatcgacagatttttctctagaacgtgacttatccctcgatcgagatctgcctttttccttagagttattctgtgatttcttctgacttctggaagatactgaaccggtttgtgagcgagattttggagatttctcattagatgaagaattggtccttctggacttcctttcacttcgagattttgacctactcctatgtgaatttttccgacggtttctatttgatttggattgagaccgtgacctttctcgtgaacgagattttcttgacctttctcttgaataagacctagatttagacctgcgtgaacgtgatcttgatctgtaggaacgagatctggatctaccactccgtgatctattccttgaatgggatctactccgagatggactataagaacgtcttctactatctgatcgcgaacgacttcttcttgagaaccggtgaggtgaatatgagcgtctcctatctacgtatattctctcatcatgctcgtaaagaaatttagtgaggtacttttgatactcttcgtctgtatcttgcgggtactgacgggggttaggtgcacgatatcctcctctgaaacgtggctgaaagttaccccgtcttctattaaatccacctctagatggaccaggtattccgggaaacctcggaaatggtcttcctcttggttgcaaacctctcattgatgcaaaggggttcattgcatacataggacccggtggcagtggatattgaaactccatccaggaaggatcataaaataattctggatatttttccatcacaggagttttgggtctttgccttatgtcttcatcttcaatagaaaaatctgagttagagctggacgaggagtattttcttggtcgtttgccatcagaaagaatgcttttaagcatgacccttcctttcaaaatattgtggagcttttctctctgagtgagaacttctagctcactagcgtttttatatctcttcagctcatcatagctagggtttgaaatattatcatacagttgcatattgtccgattttttctctttgatccttctgaatagttcttccaccagtctaatagcttccaactttctttgaaccttcaaaagtttcttctcctcctttgcaattttttcgttgatttcatcgcttccagtaatttccagtttttcgagaatttttgcttttcttttctcttcacgaagcttgcggcgtagcttcttctgttcttttatatcgacctctttttgcctaaaaattatcactaatacctcacgatttattatatcgtgtaacaaaatagtatattttgcagtcaagctgaagtatttgttattttatagcttggtagaaaacttttgctttgacgaacaattgacaatttattctaaatggctgaaaataacacatgtctgtttgagtgctctgatggaaatgataaatattcattttttactgcaaaagtgcataacattccacaagatttgcattcagcgaatgagaaattttcataatcatacacttattgatattactcctacactccaaaatttaaagatgaatataggataggtttgtcagcagaattattattcttcaaaaataaattattactgactatatatcagcaaaatttaatttacctgaaccttaaacaagtttggatcatgcatgatttcagagaagtctcatcaatgcctgaatagttttttttttatcaattttataaccttcgtactcaaatggtgcaagaaaataaattaatagataaacataagatatggaaaaaataatattcagtggggaaaattctaccaccttactacgaatggtagaattatcccttgaatgagtagttatacgtttgattcaagtactctttgaatatatcacaaaaaagttgtagataattacaaggaaaaatagatttgctgaatctatgattctttgaaatgaaacaaatagaatattcttcaacaaatactctcgaacctttccaactcctccattcgttttttctcttctaattctgcttgttccttttcttctttttccctgttctttttcactaatctatcacgaacaatttctctcctacgaatagaagcatcactcaaatgtttacttttgtcaaagtccaccttgatgttcacttctactgctccgtcatcttcttttcgcactaacttcatgttacgaaaggcatccatggccttaacgaaccctatataatctttgaattgcacatagccctcgaagaactcagttttatcgaacgatgagttttgaagtcccgaaatattttctttcattttttttctatacggatcacatattggaatgtccacaaaccgaatggagccgaatttttcgaagattttataaaaaattttctcagatggagtgacgtcttcctcattgcttagatgatatggtactaaccattttgaaggtagatgtgatatgtgtatggtgtcggggcgttctcctggtttcatctcatccatatcacgagcgtttgagaagaaatcgtcccaaacacgacgattgggataatctgatctccattcggctgctcgaattctcattaagtcggaaaaatccttgagttttatcatcttgttgtctacttttgatatgacccgctcaagcttctccctagtttcaatttcaccttcgaatctaacgaattcgacagtagtttttgttacttttagcaccgtaaattcatcaggcttaataaggcaacgaattttatccataatctcccagtgtgaaacacttttgcctaactttttcacatttggaagttgcaaggacatattcagtcgagctatgggcttcaagtaaagctgttgaggaaggtatagcggcaccagatccgaagtgtttgggcatgtctgaaaagcattcataattagagtattttttcgttatacttaaatcgattatcattaaatattattataaaaaaaagcctctaattatataatgcttattcgattaaaacattttgaagtcatctttaaagggaacgatctattcttttgaacttaatctaaaagaaaaaccgaatgtttatcaaaaccgtgcaa

SEQ ID NO: 663 - DNA, 1742 bp, Leptinotarsa decemlineata
  Annotation=Chitin deacetylase 4; Tribolium gene name from OrthoDB database=TC007635; Blast E-value Tribolium Gene vs. Leptinotarsa Unigene=0
atacagaaaaggtgagtggaaaaaagtatctgaaagattttttattttacagaagagtgtgtattcaattataaacacatttttggcccttcattcctaccagctattttatattgactgggattgatgaactgttcctggagagattcatcaattagtcaagtgttaacaaattattgaaaataatttgatgctcttgtataaataacgaaataagaccaatatattgaaccaaaatattcaaagtatttttcactttctaacattatcaggaacgtaattgtcttttcctggaattcccgaaccgctggcgtcgtctaaccaaggatattgtttagggcattcattgcaagtttccagataacgcgtgtcggtaaaattccattccggtcgcttaaaactcaaagcacatttgttgggcaaattgcaaggtttgggtggtaggttttcctttttgcagtcccaaggttcgtatttgttgagttcactcactgttttcgggtctgtgatccatgtcaaagcttgggtgatagtgacaaaccaaacgtcatctaaagtttggacccaattcaaaaatttatgtaggccttgttctaattccttgatggagaaccagttggtatgaaaaggcatcatgtatggtgctctgttctgatcgtagtatctcaaaaaatcttcctgtagccattcaaagacatcgtcaccatcgtggttatgcaaaacacattggtccaagtaagggcagtgacctccctcaaacccttccacataatgggtgttcagaggaacttcccaaacgccaggaaatgacttggtgggacatgttccagatttacactcgtgtggaattttataatctagagtgtacggccaaactggaatgggtaaagcgggtactcctattgagctgtcgtaaatatatccaaactcttctagaaccttatattgagtattacgccctggcttcaaaaatggtgccctcattcctacaacttcgcttttggaaatgtttgacaaatgtttcagaatgtccctcattccaaccatctcaccaacccattcttcgtatcctttattttctaaaccagtttggagcgatattgtttctgttccaatctcatggccttcgctagcaagttcttgaatcatgtggtaattgctatattcgtgagaaatgaagaaggtacctttaatttcacatccatttgggttctttctcttatggttgaacacttttctgtaatgatcgtagttattcaaattaacggcaccgtccaacgttagtacaatcatttgaggtatttcttctggatctaaatttcccggtacaattgtgccgtccttcgaacaaaaacaataaggcaattgacatttcgctggatcgcatttcgttgctagatctgttggagtttctgtgactggagatggcgtcgattctaagggtccacatctcgcttcatttttgaaagtgcaatattttgcaacgtcatcaaaatagagtccagatgggcatctgttgacatatggaaacccatcgacacactgataaaatcttttacatgttgccgggtccgcataatttccatttccagtgctctggggacattcgaattctttgccatcagctttacctttttttttggtcgttttggcttgtaactgtatttagaccaatacaaaacaaggttatcactattaagtcgaagaacatacgtagagaagttgccatagtatccacgcca

SEQ ID NO: 664 - DNA, 1422 bp, Leptinotarsa decemlineata
  Annotation=Suppressor of profilin 2; Tribolium gene name from OrthoDB database=TC000050; Blast E-value Tribolium Gene vs. Leptinotarsa Unigene=9E-136
aagaagaagagaaaaaagataaaaaaagggtgtgttttttactttatgaagctcgttttgggagttggagcagaagtataagttcttttagcattatatcttgtagttcgagcattacttgagcactaacatttcattcgtgttgactgaccagagtccacgaattggtttcaaagatgactgaacaacacaggttcgggaccaacgtgagccccataacatgccacgcttggaacaaagacaggactcaaatcgctttgtcccctaacaatcacgaagttcacatctaccaacgaagtgggtcggaatggaagctggtggacacactcaaccagcacgacctgcgagtgatgggcatagactgggcccccaacaccaaccgaatagtcacttgcgcagcggaccgtaacgcctacgtctggtcgcaagataaagacggcaagtggaaacctactctggttttgttgagaataaaccgcgctgcaacctgcgtcaagtggtccccgaacgagaacaagttcgctgtcggatcgggagcgaggctaatatcggtgtgttactttgaatctgaaaacgactggtgggtgtcgaagcacatcaagaagcccatccgctcgacggttacgcatctcgattggcaccacaacaatgttcttcttggagccgggtcgtccgattacaaggttaggattttctctgcttacattaaagatatcgagaagacccccgaagctacgccgtggggtacgaagatgcctctggggcagttgatggccgagttcgtcaattccagctctggtggaggctgggttcatagcgtcagtttttctcctgatggaaataaaatatgttgggtttctcacgactcgtcggtgaatgttgctgatgcgaccaggggcaatgcagttttcaagctcaggacggaatttctgccgttcctcagctgttcttggataagcaacaagtccgtggttgctgccggtcacagctgcatcccgattttgtacaagtacaatgaaaacggacagttagcttttgtcgctaagttggacgcttcccagaagaaggaaaccggtggattgtcggcaatgcggatgttccactctttggacaaacaggcaagatcagaaacgtctgatactagtttggattccattcatcagaacgccatcacttgcttgtgtatttattctggaactaaagaaaaagcgctgaaactgtcaacttctggagcagacggtcaactagtcatatgggatttgaattctttagagaggtccatccagaacatgaaaatcgaatagttttttttgtcttgtaacatttgcgtttatgaaaagtatatttcaattgattaaagctcttaaaagaaaaaaaaaaaaaaaaaaaaaacgtaaaactactagacgttagaataaccaa

SEQ ID NO: 665 - DNA, 490 bp, Leptinotarsa decemlineata
  Annotation=UPF0587 protein CG4646; Tribolium gene name from OrthoDB database=TC007353; Blast E-value Tribolium Gene vs. Leptinotarsa Unigene=4E-4; Blast E-value Tribolium Gene vs. Leptinotarsa Unigene=0
agatgtgtataagagacccagattatacatttttggtgaaattcaagtgcatcaattgcggagaaatatcagataaatggcatgatgtgtgcgaatctcataaatttcctggtagatcagggaaatatgaagtcaatttctgtgcaaagtgtaaattatgctctcgagaaggtaccgtccacattattgccggtagtaatggaaaatataccaatgataaccagggaaattttgctcccattgtaaccttcgaatgccggggatttgagctcatagacttcacaccaggaacaggatggatcgcgaaggtggaggaaagcgcaacaatattcaaaaacgttgatctgtcagataaagaatgggttgaatacgatgagaaaagtcatcaatctgttagtgtttttttactttgagtcgagatttgttccagtgaaataaatattaaatatacatattgaatatacaaatatccatattaaattaaacatac

SEQ ID NO: 666 - DNA, 1460 bp, Leptinotarsa decemlineata
  Annotation=Adapter molecule Crk; Tribolium gene name from OrthoDB database=TC004767; Blast E-value Tribolium Gene vs. Leptinotarsa Unigene=1E-144
ctttatttgtgaaaaagctgaaatgctattttacaataaaacgaatgactgaaatattgatatgtaattaataaaaatacaaattgacatcaacagcgcattgtataattattgttcataaataatagatgaatatagtatatatgtatataaggttaatgttattgccaattaaaattaattaataaatatacaataaaagtcggggttctatacattcaacattagcaaaatattttgaaaattttacaattgaataaatgactaactctcgttatcatcatccagaaattcaacatgggtgaatggaaaatatcctgttttaccgttaagctccccttcccactggccatttatattggtttttgtcaccgttattatgtcgccaatttctagtttcagagctgtatcgtcataggcgtttggaaccctaacttgcttcacttttgcttttgctggaagttttcgctgcatttgatttcgtttggctgcttcacatggcaacaatgtattattaacagcgacaccagatccggagcggagaagatctacaggggaatgactttcctcaattttctgtacatatggaacaggaatagatcctgtttgtccatctttgtttttcgctgtccaccactgttcttcatctttgaataatatagttaaaatatcaccttttttgaaactaaggtcatccttttccttgccatcaaaatcaaacttggccacaactttctcaacctttttactggcaggtctaataagcggagtggtatctaagtaatgtactttgtaaaatgcaagaagctctggtatgtttttgaaaaagttatccccaattttatatcttgcttgatcctgcacctgggttttatttataatgtaatgacttactttactatcttccttgacacataatacaaagtctccaacactagttttactatctctgactaaaaaaacaccaccttctctttcagacatcagtaaatctgtagcctcatgacgaccaatggccccaaagtaccagcaatctttatcttcatggtcaaaggaactagccatcatagttaactataaactatttttgcaaacacttaaaaaaatatcatgatgaaatttggacttccttaatgaattaagttatagaatgcattatcctactggctcattcacaaagacatactaattagataactcatgaaatattctcgttaaaagtaattgttttcaattaattttttttggttaagtcctgaggtctcctttcatgttgaaatacagcacacagtagtatgaggtgtgtgattcagaataactacagcttctcaccagttacattagggttttgatcatttcggaaaaaattataatctatttgcaatttcgtttctggaagaaaaataccctttcagattctcaaatatggcgacgattctgtcactaactacagaacatcc

SEQ ID NO: 667 - DNA, 1682 bp, Leptinotarsa decemlineata
  Annotation=DNA polymerase zeta catalytic subunit; Tribolium gene name from OrthoDB database=TC004938; Blast E-value Tribolium Gene vs. Leptinotarsa Unigene=1E-52
tttccaaaaagatgcgactctgttagacccgaaacccatacatactccagtctgtgatataaacgtaaaacgtcaacttttcaccgaggattctccattaaactcaactaggattgaagaaaaactagtgtgccgccatgtttcagtcgccaaaagaaattgtattactcagaaaattccagatgaaggtgaatctgaaaagtcaagttcgagtattttcagctctgacgatgactgtaatgaaatgtcattcttcaaccctctggatatccaagacaatcaaacttatacgacgccagccgaaaagtacgacaaagaaaataactatgtcgctaaagaggggtcttctaaaatgttcactccactccaatcgcaaacagatcctcctgatattcatatatcatctgggagttcaggttcggtactgattacacctggtcaaagatttgtgagcgacgatgaggatctgactaaaaatagtactgctgttatagagaaacatttccaaattaattatttatcttctaactctgttactaacagtaactcttcttcaaatatcagcattacaacaaataaaaaaggacctagtaaacgtgaagtggtggaatccatggaaaagtacggattgctcatgttagacagcaggtaccattttacagtaatgtagaagatgttgcaggaagcatcgaggtgggattcaacattctaaaaataagcagtttaacaacagcacatcttccggaattcgaatcacagactgatagtttgaatattttcaggaaaaataagttggacattttatcacctaccttgcagtggagttcttcgagtataaaaacaatgatactcagtttttgtaaggacagagaatgtattattactcctgttaaaagaactccaacaactaaagaggtattaaattggttgaaggaaaaggccgtgaacgacgttataaaagaaaaaaatatagagaaaagaaccaaaattcatttgcctttgagcccgagaaatgaaggaaaagatgaagaatacgatttggatatgagtctaactttaactccttgtactcctagcaattcccagaacagttccaaagcagcagaacgttcagctgattcagcgagtcctgtttttggcaaagaatgtaaggcaagaaaaaaagaaattttcaataagactttgagaacgcctctgtttccttcccaggaaagttccataaaccattcttgtcaaattactggtttaatggtaaatcatagcttcgaaaagtcagcacgcaacctgcaggatgctcgtgctgtcttggaacaccaaaacataacagtgcttgttatggaactacacatccgtacacgaggagattttaagccagacccaaatcatgattcaataagagctatattttacacaatacatcacgatgtacctgagcctagtaataaagcaaaaacgtgtaagggtgtgatagcaatcaatgatttgcctctcagttccggggtttccaatactccgattttgaatggtattggactagattgcaatattgcttacgtggattccgaagagaatttattcgatgaatttttgaaggtcattgcttactgggacccagatatttgcgcaggttatgaaattgaattattatcgtggggttatctcatggatagagcaagtcacat

SEQ ID NO: 668 - DNA, 2601 bp, Leptinotarsa decemlineata
  Annotation=Nucleolar protein 9; Tribolium gene name from OrthoDB database=TC000158; Blast E-value Tribolium Gene vs. Leptinotarsa Unigene=5E-85
ttccgctctcgagaaaattattgcatttcttgcgattgggaaaagtgcttgttttttaatgtattttagttttagattttattcaataattcagtctatttacagccacaataacgtgaaataaatccaacaagtaacaaaaattattcatagattctattcactttttatttacaggaatatatgatcttttcgtgatttgtgccagatactccagttcagcctcttgtacgaaagggatatttcctgtaatttcatccggagacatataaacggatggaggcaagtaaacgctattcgtaaccaaataatacacctcctccagaacttcttttgcttccggtgtcatcaaaaccagattgttgctggtcaagtctatccctcgaactataccatatcccatacaacgaaatatcttggaagttgtatccatcgaacacagagcaaccaaatttgtatttactgctgcaggacacgtctctgatccttcttcatcgactatttttatggaatctaaaccaatctcgtacattgaattttcacatcttgtcaaagagttgacacccctggtcatcattcgtcccacataactcaaaacacacatttcccgtgcttgcctggatcccacagtccacccagtattattatcattcatcgaaggcaactcatgcaacttgaagtttatatttgatggatctccttcaaaaaaacaacagtacttcctcgcggtattcggtgacagcttttctttaaagtttttcttggaggactgactcgaaatttgaaccacgtctgtgggaacaatgtaagctatagcggatgagacaatttttaagccgacaccctgagtgaatcccatgtagtttatcagggtaggaatattttgcttggtgtctaattcctccaagagtaattttatggtcttgaagtaatttggaagatcatctacattgatactggaaaggtatgacctatcaggtctcctgagatgggtgtaatttggtccacaaattggttctgttacagtgagaacagaaatagaaccggggacggtaaattcagactgaccaggatccagatcgataactcttatcctatcatatcggttcaataatcgatttatagaatatttgataaatgtactttttccaacgcctttccctccagttactaataattttgttgaagtatcaacattactcaaaaccacatcccacgaagggctttcagacactacgttccagtcatcttccggctcaaattcaactcggggcctgttatcgtcgaatctgggaaatatttgttgtgcaatatgattctcggtgcatctcaaccagtcttcatctaattcactgtatttgaaaattgcaacacattcactgtcgacgaagtcttttaatccattgagtacgttcaaatttgagaacatttcgggcgggatgcattcctcatccttttctgtgacatttttaattacgagcaaagctgaacctcttggagaataaacgttgatttccttagaatgtttatttcgaacacagccaagtacttcaatacttccatgaataactttcaatgtgaacaaaccaaagaagggtaaagaacaattttttttcaacagtactatttgttcatctttcattttataatattgggctattttctttcgactacccttttttctagtaccctctgatgtattgttaacattagaattagaaagaatggcttcctctaccaacgtatttttaatttgttcatatttgtttggtggattatctaaaataggttcttcaatacacctgttattcaattcctttaacctgttattcaattcgtttacatctacttgaacagaaacattgatgtttgaaacgatttttttatcttccgctgcattttgtacttgtttcacattactgacattttctgaggaaacagatacttgctttctacaaatgttagcttttctcattccctcactaataagttcatagtctattccagagtgagcttcagtgattgagtcgttcaagctatggtcccgtgaaaaaaagaaatcatcgaaatcaaatgaattactactttcttcaccatcactaatgatttcaggtaattctgattttgaaggagaaatgaaatgtgctaaatcttcctgaaaagattcattactataagataccaccaattttctttttttagaacttcttgatttatatggtgttagtgttcttgattccttggtaatgttggaactgggttcataatcctcatcaatacggacagatttctttttcttttttgatttgtctttttttagtggacgataattttgtaaaaacagtttcagatttgtagtcatccagtgcgaatcttattttcttaggtgtcttcggcatgactccttggagtgatgtttacctttatattcgagaagtataagcagtcgtgctttattgcgctagagagaatctcattggaattacatgaagaataaagacattacagattcaacacaggtggataagtaaattctctcatttgccttatacaatttaaaaaacataaccacaccacagaggaaacaaatcttatcgcctc

SEQ ID NO: 669 - DNA, 1145 bp, Leptinotarsa decemlineata
  Annotation=WD repeat-containing protein; Tribolium gene name from OrthoDB database=TC000064; Blast E-value Tribolium Gene vs. Leptinotarsa Unigene=4E-1; Blast E-value Tribolium Gene vs. Leptinotarsa Unigene=03
ggtaattttcgggggttatgttttgattgtggattgtagttatatttgttgtatatatctagcgaaatggttatattaaggaaggtagaaaatgagttttttatatcaaaaatggataatattattcactgtgatttggagaaatgcatagaacaaattcttgaaattcctgaacctattttgcctgaaaatttaacaaagggtcagatggaagtgttgaaaaaagagatgagaactgttacatctttggaattctctaaattcagggaatatattgtggtttcaacagagaataaacaaattattgtttatgataaacatttcaatatagtgaaaaatatcatcattcatcgtgcagcaagtaaggcatgtttcaccacatcgaatgacattctagtggccgacaaaactggggatgtatatttatataaaatttcgaatgaagatgatgtaccaattctcttactgggacacttgagtgttattttagacatgcagattagtgaatgcggaaaatacctcattacatgcgatagagatgaaaaaatacgagtttcacattttccaaattgttacaatatagccagttactgtttgggccattcagaatttataacgaggctggtaatagttgaaaaattgttaatatcagcttcaggagatggaacagtgcgtttttgggactttatcaaaggaaaacaactaggtatcatcaatacccacaaacacataagcaataaaagtttactggaagacttttgtctggatatggataaagagaaagtggaaatttcagctcttcctattaccgatgttcaagtatgctctggtgataaactgttaattgctgtatcagttcatagatataatgctatccaattgttcagtacagacttgaataactttgagtcacattttattgcaaaattatgcttgcaggatccatttgtattttgtttcagtaataatgaactctacatcttaggcaataagcttagttgttttcaaattaatgataattttgatatagttgaaaaaaatatcccttctttagaaaatatttctgaaaagttccaaagttattttaacaagaaatttgaagatactagtataactgtactatacaaagaaatatgacaatagtt

SEQ ID NO: 670 - DNA, 2403 bp, Leptinotarsa decemlineata
  Annotation=Polycomb protein esc; Tribolium gene name from OrthoDB database=TC004463; Blast E-value Tribolium Gene vs. Leptinotarsa Unigene=1E-68
gggagaagaagaagacgttctatgtccctgagtccctggactcctgtgtcctggatctgtgtcctggacgaagcttttgtttacataacggtcagttacttactcagttatgaatttatgaagtgaagacaggagactggacagtagcgcgtaaataggaatcgccttctacatgaagtgcaacggcttcaattgtaaaaaaaaacagtctgtttatagactgaaataaataaaaaaacatgaaagaaaaatgcagatcaactcccaaagaagatctctccaaccatgaagaagaatctggtgacgagggggatgaaacctccagcatcggtagcacttcaactaccgacaacacatcaagaagtgcaaccccaacaaatcgaaatcggaaaggtcgtaaacgcaaaaatcgtttcagcaataccacccctaaaattttgaaaccaatatatagattttcatgcagtattaaggaggaccacggtcaaccactatttggtgcacaattcaaccaccacctgaaagaaggacaaccatttatttttgcagctgttggtagtaacagagtaagcatatacgagtgtcctgaaggaaatggaatcaaattgacacagtgctatgcagatccagatctcgacgaaaacttttacacttgtgcttggtcctttgaggaggaacaaggaaaacccctgttggcagtggctggttccagaggggtcatccgtattcttaaccaagctacgatgagttgcgtcaggcattacataggccacggtcacgctataaatgaattgaaatttcatccgagggatcctaacttgcttttatcagtctccaaagaccattcactcaggttgtggaatataaaaagcgatgtgtgtattgccattttcggaggagttgagggtcacagagatgaagtacttagcgctgattttgatttgatgggcgatagaataatgtcgtgtggtatggaccattcattgaaattatggaaacttaataaagacagcatgaaagaggctatcaaacagtctttccactggaatcctaatcgtaatacaaggccgtttgattgcctgaaagagaattttccagatttttccacaagagatatacataggaattatgtagactgtgtgagatggctaggagattttctgctcagcaagtcttgtgaaaactgtatagtgtgttggaaacctggcagattggaagatgaaaatctgaagaaaggagagacgagttctacaatcattcatagatttgaatacaaagagtgcgaaatatggttcatcagatttgcaatggatttttggcaaaagattttagcactaggaaaccaatgtgggaaagtatttgtttgggacttggacgtaccagatccggcacaagccaagtgttacactttgcagcatccccgctgcaccactgctattcggcaaacttccctgagcagaaacgccaatattcttatatgtgtgtgcgacgatggtaccatctggcgctgggacagaatttcataaggacaatttgttattgtatttttttaatataaactactaagcaacacactgtttcattaaaccacttattctttttctttcgcgtctggaggtgacagcttcttcctcagctctttgataatacgaaccttgggttcactggggcccacaaacttagaatccgttgtccgttctaggggcacgtaaacttcgaaaaccttgaaatatttcagtatagaattgactttctcctcgggaagtaaacagtcttcggaaattttctttgctgaatattttctagggtcaccttgatggtttgtgatgaattctaacgcagttgctagtgaaacctttcccagtggaattttttctgactgcttaacaccataaaggaacgtttctactgctttcctgtctgtgggaagaggcctttctggattttgttctagtttgtgtgctatattaggatcatgtgaggttacgaatatatctttcaaatgcttgtcaagtttctcatccttttggaggctttttgcataaacgtctgggaattctttcataagccgttccacatcaatttggtctttttcatgcagaggtgcaggaataggtttgggctgggatatcactttgtgagctctatattctaaattaaaatttctaaaagggtgcttaacagtggaaaatatcttccccatcttcgttcctttttgtaaggttatgtaatgtaacttgtaactcgaacatgcattcccttgtcaataaagttttcatccgtccaatagcagggctcctaagaatgaaccgttttatacggatttacttagaagtaattggttaatcactttgatcattgagttttcttttgttttcgtcagtatctgtcaaaataaaactc

SEQ ID NO: 671 - DNA, 949 bp, Leptinotarsa decemlineata
  Annotation=Coiled-coil domain-containing protein 124; Tribolium gene name from OrthoDB database=TC004658; Blast E-value Tribolium Gene vs. Leptinotarsa Unigene=1E-54
gagagagagagatagtcgatagtgggcactttcaattacggcactattttcattttctctattgtactgtgtttggcgtttgggcacaattgaaggttcataaataataacattggttctaatctgttttggtctagtatagacacaaaaacgttttgaagtatgccaaagaaattttcttctgaaaataccaaagctgtagtagctcgagaaaagaaaaaacttgctaaagacgaagcaataaacaagaaacagagggaaattgaagatgcttattggaaagatgataataagcaactacaaaagaaacaacaaaaaaaggaaatggaggagaaaaaacgggaagaagcgctcagaagaaaaatagaagcaagatcccttctagagaaagagttagaggaagttagcaaaaaaacaacaaaacctattcaaaaagtaacacgagcccagattagtgtaaagacagccgttccagtcaaattggaaaaagagaaaaaagttgagactcacttggatcttcctttgatcgaaaatgttaatagactgcagattgatggagaagaagccagaactgtagatgaggcactatcgttgctcgggaatgaagatgcagtttgtaaacacccagaaaagaaaatgaaagcagcatacaatgcattcgaagaaaagagactcagggacctaaaaacagaaaatcctaatcttcgtctatcccagttgaagcaaatgatcttcaaagaatggggcaagtcacatgaaaaccctctaaatagtcagtgaatggaggtagtcatcttgaatgctgatagattttgatccgctcgtttagtgcggactaactcgtgaaaataagatttattcattttatttgatggaagatactgttgaagcttagtcagtatagtcaatgaatttatatatgtatttaatgttggttgataaatctgat

SEQ ID NO: 672 - DNA, 812 bp, Leptinotarsa decemlineata
  Annotation=Charged multivesicular body protein 6-A; Tribolium gene name from OrthoDB database=TC006745; Blast E-value Tribolium Gene vs. Leptinotarsa Unigene=2E-59
atatgaatgaacatttgaggttatgaagtttattatttgtgattgttttggatgttcattttcatgtaagatattgtaattgacggaaaacgtcatcaaccctgtttaatcttgatcgcatttactatggggataatatttggcaagaagaagaaaacatctcgagtaactgaacaagataaggcgattctccagttgaagcaacagagggataaattgaaacagtaccaaaagagaattgagttatcattgagcaaagatagagacattgccaaaaaactattgagtggtgggcaaaaagatcgagccaaattacttcttcgtaaaaagaggtatcaagagcagcttctgacaaaaacggacaaccaattagacaatttggagaaattgactcatgaaatagaattcgcccaagttgaactgcaagttgtagaaggtttgaaagttggaaatgatgctctaaaaaaagtgaatgatgctctcaatattgaagatattgaaagtatactagaagagactagagagggcatagagaaacaaaatgaaataaatgaactgttgagtggtaaactgactgatgaagatgaagctgctgtcgaagaagaattggcagctattattactgaacaattgcctgaggtgccttcagaggatccagtaccccaagttgagaaagaagaaagtgccaaagatagtagaaaggaaaagaaaaccaaagataaggattctgtagcagttatggcctaattcttttgaaatacaaacagttgctaatgccattttacatttttgagttgaatgttttttgaaaa

SEQ ID NO: 673 - DNA, 2007 bp, Leptinotarsa decemlineata
  Annotation=TIMELESS-interacting protein; Tribolium gene name from OrthoDB database=TC008670; Blast E-value Tribolium Gene vs. Leptinotarsa Unigene=4E-43
tttagttaaactgtgacggtgcttggatgttgtctctagacgcttttgtgacacttttgacagtttttccatttgacaggaagataacctattatttttgagatttttaattatattgtttattaattgttatatttcaatatttctttttgtatcgtactcattttgactatataacaatcactgtgtaaccaacacttacaaatatgaaggatcccaagaagcaatccaatgctgaaattaaagaaccccaagttgaagtgcttcccattcgacaaataactcaaacagataagttgaataaacgcttgctggagtcatttttgactagaattaaccgagagtcgtctaacggattgaatcagacgccttcacaacacgagaatgaaaggaacgaattcaactagatttttgtcactgtaacatatcctaacctaaaattaaataaaacgcgggaagatttcacatttatgggtcgtgttttacttgcatcattttttttgaagttgataaaaatttttgaagatgtcttctggagatgaatcagttgatattccagatgaaatagacttgattgaagaagttgagggagaggtggacaaccccattgaaaccatcgaagaacctactgaagaagaagctactccgaatactgcgaacaaagattccgatgatgacgaggatagttctaaaaaagttgtcaaaccaaaaagagttataagaaatcctcaaccgaaactaaatgaacaaactctgagaacttcaaagggtcttccggctctcacaaaccatttcaaacgtgtgaaattcaaaggtcgaggtcatgaagccgaagatttgaatgttctcatgaagacctatgagtattggtgtcatcgtttgtttccaaagttcccatttgatgcctgcattgcaagattggagacgcttggtaccaagaggggcactcaggtacttatgaaaaaaattagattgggcatggaaatagcagatgatgataataaaatggtgagcgatgaagaacatgagggagaagcagttgctacagaaggttttagagatacctttgataaccggtttgatcaacttttaacaggtagcagggaaagcgaacgaactggtgaaccagatacaactgaagaacaactggagagaatccgacagaacagattacgtgccgaggcattaagaaaacaaagattagagaaaaccaagtcaatgtctcaaaatgaaacgaacatgaataattcaagtgctgggaatgtagttagttctgcagataatattttaaatattgtaaatgaggacattgaatctgaaaaaccagaggagactgaaatcagctcaactagtagatcacgagtactttcatctgacgaagaagaaattgcccatagcgaaaaatcagaaaatgatgacactgaaaatggtggcagtattcgtagaaaaaaaatcctcaccatcgaaagtgatgatgaacccgacacaaatgtggaagagaatcatatagatactattacaaatatttacagtcaagatgaaacacaaaccaatgaaatggaagcagatgatgaagaagtggatttggacaatattttgaatatagtaaatgaagaaactgaaacttctctgaaaaaaatgcatacaaatttgagtcataatgaaacaaatcaaaggctggagcaaagtcaaacccaaactgatgacatggaagaggttgactttgataatatattgagtatagttaatgagaacactgaaattccaacatcaaaaagtccacatcaaaatagaccagcgtctgcagataacaatcaaggtgggatgatcagaactgacaattatgaagaggaaaatagtaataaaagctctcgaaagaaaagcatccaaggaattgaaagtgatgaagaaatggatacaaattagtttcctcaaaaacatccctctgcagaagatagtgagataattaagttaggtaatgttacactgggaaaataaatttaatag

SEQ ID NO: 674 - DNA, 2704 bp, Leptinotarsa decemlineata
  Annotation=AFG3-like protein 2; Tribolium gene name from OrthoDB database=TC002463; Blast E-value Tribolium Gene vs. Leptinotarsa Unigene=0
aacgtaaagagcaatttaatggtacctgatgaaaaattaataaaagtccctccaacaaaagttcctcatatattcaacaattcaagactcaaagtcttatgagataatgaataataaaactcttacagaaaatagtacattcgcaatgtttattgtttatatcacacttgatgaaaattatgaaatgcctagttaaaatactttacattacgactacagagggaaacaagcaaaacagtacctaaacttgtggaggttgtgtagtgactggattctccctacatttctctttattccatccttcaaaccttcaggcagtgtcgtatcctcttcgaaagaaccagttccttcaacaaactcctcataggtcgacttctcagggaatggtctctttcccaacaattcgatcatgtcatctctactgataatttcttgcttcaacaacctctccgctaccttagcgactagatctttacgctctgtgagcaactgcgttgtccgtttgtgcgcattatcaattaatttcctaacctcaacgtcgatcaactgagctgtgctttctgaataaggtttctccagcatcatctctccttcgcgaggcatatcaaaactcacattgccaaccttcgcgttcataccgtaatgtactacttgcgcatacgcgctctgcgtcaccttcttcaaatcatcctgagcgcctgttgttatccttccaaagaaaagctcctccgacactctacctcctagagtcatgcacattcggtcgaacagttgctctttagtatacaaatactgatccttaggcaagtactgtgcgtagcccaaccctttccctcttggtatgatcgacaccttgagaagtggatcggcatgctgtaaaaaccacccagcaactgcgtgtccagcctcgtggtaggctactgtctttttttcctcgggcgacaaaacgttcgttttcttctccattcctgctacaactcgttcaatggcttgttcgaagtgcttcatattaatcgaatcgttcaaatctcgggcggctatgagcgcagcttcgttgcaaacgttagcgatatcagcgccagtgaagccaggcgttaaagccgccatcttcctagccaaatcggttttgtcgaggagcgtcttcagtggtcccagatgtaccttgaaaatactagctctgcctttgatatcgggagctggcacgaatatttgtctgtcgaatcgcccaggtcgaagcaaagctttgtctaagatatctactctgtttgtagcggctagaactacgacattagttgtggtattgaacccatccatctcgaccagaagctggttgagtgtgttttcctgttcggaatgacctccaaaacttctaccgcctcttttccggccaactgcatcgatttcatctatgaatagtatgcaaggggcatgttttctagccatggaaaagaggtctctcactctggacggaccaacaccgacgaacatttcgagaaattccgaaccggatactgtgatgaaaggcacgttggcttccccagcggtcgccttggctagtagagttttaccagtaccaggaggtcctgtgagcattgcccccttaggaattttagcgccaagatctatatattgttgaggattcttcagaaaatttacaaattccataatttctatttttgcttcttcacacccagcaacatctctgaatttaactccaatatcatttgaatttatgagtttagctgtactttccattacgcccccaaagaggccgcctcccctctttcctctttttccacccatcatttctgctgaccttctcatcatgtagatgagaaatccaatgacgaggagagttggaagcaatcctgagagactagccgcttctatctcagtcttgtaaattacaggtacaaaattagcaggctccaagttcatttctacctgcgcattttcaaggtttctttcaaaggaatctacactcccgatattgaaccaaatgacattagctccttctactgtattaccaggtaaaagtttcacccgaacccacttcttgttcacaacttctaatttatcaacaactcctctttgtaaatagttatgtacaaattccttccagcctatttctttgtatcccatttcccacatcgtaacagttgctagaaatgctacagctgctgcagctcccagtacgtaccatttgtctctctcattatctccaaaaggtttaccaccgctacctcccctgcctgttcctccaaaaagtccaaaagaccattgttcgtaaggtttcgaaccactaggacccgtagaacttggaggaggtggtttaggtgcttctttgggttgttccggttttgtatcctttgcagcttttccttctttcacaggttctttcaaattctttgcaccacctggtttgaaatacttttcgaaccctttaggtggcttttcacaaaatatcctgaattcgttcagtactgcttgtttcaatgaaaagtttatctgtgaagtatgtacattacactgcttgaatgttttccacactaaattttcaattttcctacaactattaaagagacgatatgccattatgctgtataaatctcaaatcatttgctggagttttctataagtcaaaataaaatcaaatcacataactttattctatacacaacctcacttttcggattcaggttcc

SEQ ID NO: 675 - DNA, 3963 bp, Leptinotarsa decemlineata
  Annotation=Flightless-I, putative; Tribolium gene name from OrthoDB database=TC012416; Blast E-value Tribolium Gene vs. Leptinotarsa Unigene=0
gatgaaatatatgacagatttatttgtttttagtttcatttactagttctctaataaattagtggatattttttaatcatgtgtgatttttagatgtgaactaactaaatatacaattaaataatggccaacactggagttttacccttcgtcaggggggttgattttactagaaatgattttagtggggacaaatttcctgatgcagtaggttcgatgacaggcgttcagtggctgaaactagatcgaacaaacttagaagaaatacctaaagaaatgggaaatttactgaagttggaacatctatctttaacaagaaacaatcttgaaaaactgtttggagagcttacagaactgaattgtcttaggaccttgaatttaaaacataacaaagttaaaagttcaggaataccaccacaactgttccacttagaggaattgactactctagacttgagtcataataatttgaaagaagtcccagaggatttggataaagcaaaaactttattagtgttgaatttgagccataaccacatagaagccattcccaattctctcttcatcaacttaactgaccttctgtttcttgacttgagccataataaacttgaaacgctgcctcctcaaaccagacgactagcgaatttgcaaacattaattttaaacgataatccattaggtcactttcagttgaggcaactgccatcacttttgaatattgaaacgttacaaatgagaaacactcagaggaatctaaataattttccaaccaatttagacagtctaatcaatctttgtgaagttgatttggcacaaaatgcccttccaaaggtcccagaggcattgtattgtttgattaatctgagaaggctgaatttgagtgaaaatgaaatcagtgaactatcatcagctatggaagtgtggcagaaactagaaactctgaatttatctcataataacattgcaagtttaccagcaaccctttgcaaattggtttcattaaggcgattttatgttaatgataatcaacttgactttgaagggattccttctggcataggaaaattaggaaacttagaggtattttctgccgccaacaatcacttggaaatgattcctgaaggtctttgcagatgtggatctttgaaaaaattgaatttaagctctaaccgtctgataactttacctgatgcaatacatcttttgactgacttagtgacactagatttgagaaacaatccagaacttgttatgcccccaaaacctgttgaaactactaaaggttctggtgtagaattttacaacattgacttttctttgcaaaatcaactgaggcttgctggtgctagtgtacctactcctgcacctgtacaaaatcctagcaaagatccaatagcaagaaaaatgcgattaaggaagggacgaagagatcatgaggaagctgatcaagatcaagcaaaaattttgaaggggatgaaagatatagcaaaagaaaaaaatagaagtattcaagaggatgaaaaggtagaatcactcaagcctaaaaggtgggacgaaactttggaaaaacctcctttggattattcagaattttttgaagatgatgcaggacaggttcctggtcttaccatttgggagatagaaaactttttgccaaaccgtatagacgaagttgctcatggaaaattctatgagggtgattgttatatagttctcaaaacatttttggatgaaaatcagtctctctcctgggaaatatttttttggattggtgaaaaagcctcattagataagaaagcttgctcagcaatacatgctgtgaacttgaggaattatttaggtgcacaatcccgcacaacaagagaggaacaaggggaagaatctgatgaatttctaggccttttcgattcacacattacatatattgaaggtggaaggacatgtagtggcttcttcactgttgaggacatgaattttgaaacacgactttatagaatccacctatctggtccttcgattcacttagaacctgtacccgtttcatctgattcattggatccatgttatgtgtttctcttagatgctggaatgaaaattttcttatggaatggtaagaaggccaagaataccctaaaatctaaatctaggttgatgtgtgaaaaaatgaataaaaatgaaagaaaaaacaaggctgaaattttatcagaaaatgcaggtaatgagagtaaggagttttggcagcaattaggtcaaccagatggaatacctcctgaagaaccaccacaggagcatgttgacccagattttgtacctgttcctcctagactttatcaaatacagttaggaatggggtatttggaacttccccaagtggaagtacctcaaggaaaactagtgaataccctattaaatagtaaaaatgtatatatactagactgttatttggatgtttttgtatggatcggtaaaaagtcaacaagattagtcaacgctgctgctgtaaaattatctgaagaattattcaatatgatcgatagacctgattgtgctagggtgtcacgtgttcgagaaggaacagaatcacagatattcaaatccaagttcattggttgggatgaagtgatagcagttgattttactagaacagcagaatcggttcagaaaacaggagctgatttaactaaatgggcaaaagaacaagaaactaagacagatttgacagccttgttcacaccaagacaaccatcaatgtctcttagtgaagctcaacaactcatggaagagtggaacgaggatttagaagccatggaagctttggtattggaaggaaagaagtttgttaggttacctgaagaagaattaggtatttttcattcaaaggactgttatgttttcctttgtcgatattgggttccacaagatgatgcaagcagtactcctcctgaagacgaaatggatgatcttcaatgggtgtgttatttttggcagggccgagatgcatccaacatgggttggctgactttcacttttacactacaaaaaaatttaaggcacttttccaagacaaattagaggttgtgagaacttatcagcaacaagaaaatatgaaattcatggcacatttcaagaggaaatttgtcataaaacagggaaaacgaaataaaaaagcagataaaaatgcagtagaattttatcatttgaggtcaaatgggagtgcattatatacaagacttgttcagataaaaccggatgccacgtttttgaattctgctttctgctatatactcaacgttccttttgaacaagaagatgattctggaattgtttatgtttggattggttcaaagtctgatccagaagaggctagaattattcaagaaatagcagaagaacttttcaacagtccttgggtaactctgcaagttttatcagaaggcgaagaaccggataactttttctggttgggtttaggtggcaaaaagccttacgacaatgatgccacttacatggaatataccagacttttcagatgttcaaatgaaaaaggatatttcattgtttcagagaagtgttcagatttttgtcaggatgatttagctgatgatgatatcatgattctggataatggagatcaggtatttttatggctgggtgccaactgtagtgaagttgaaatcaaattagcctataaatcagctcaggtgtacattcaacatatgagagctaaacaaccagacaggcctcgaaaactgtttttaactttgaaaaacaaggaatcaagaagatttacgaaatgttttcatggttggggagaacataaaaagccacctgaatgaggtccaacaaaatttcaatgaaaatgttatttatttaaagaggaatttgaactaggtttgccaataatgcagattcatgccgagttcaaagttttttacagtatttatacctcctagttcattt

SEQ ID NO: 676 - DNA, 1544 bp, Leptinotarsa decemlineata
  Annotation=Probable ATP-dependent RNA helicase DDX49; Tribolium gene name from OrthoDB database=TC007723; Blast E-value Tribolium Gene vs. Leptinotarsa Unigene=0
caacttttattaaattcaaacttaacaattgatatttgttgtattctatttagatattactttgtttttcttctttttccttttatatttcttgaatagtttagcctcttcttcgtcaggatctagcccctctaaaatccacttctttcgtttgtttatcagactcttttcgaaaaagtccccctcatctaacttaagaaaagcttcactttttgtgacagatatttgcgtgaatatctttcctacttcagtttcatcaaccttgaattctttcaaagttgttttaatcagctcttcgattgattgtaataatttgatatcagatggagtcaacagagtgatggcctttcctatccttcctgcccttgcagttctaccaaccctgtggatgtattctttaggaacttttggaactgaatgatttattaccaacgataccgttggtatatccagacccctgctagcaacatctgttgcaaatagaatttttacagttttacttttgaatttagctagtcctgcaagccgttgttgttgcggacacattgaatgaagagctacattgtcgaaaccaacttcatttaaagtcattgataaaacttgacaactcttgcaagtatctgtaaaaatgataatactcccatcctcatctttctccctgtattctctaataacctggactagatatgcttctttgacatctttggagcagagtacatagaactgttctagttgatctacggtagctacttcagcaagagaagggtcctgatagagaataacttctttgttgctgatttctttcaaactctccaaggtatctgttatggttgcagaaaaaaacaaattctggcgactttttggcaaacttgcgaaaattgtctttatttgatcatcaaactgtccaccgagaagtctatcagcttcatcgacaactaaaaattttatccgggataatgaaaatgttttacaactttccaagtgatccgccaatcgaccaggggttgctactacaatatgcggatgccttgacaactggataccttgttcaaccatgtcgatacctccaacaataactgagcatcgaatatttattggttttcccacaatggcaaactgatcagctatttgataagcaagttccctggttggtgtcagtactaatgcaaatataccatagggatcttcacataatttttgtatgatcggcaaagcaaatgccaaagtttttccacttcctgttttggctgctccaatacaatcaacccctcgtaatatttcgggaatacagtgtgtctgtataggggtgggagacttgacccctatagtggaacattgtctaattatccatttattcaagtttaaatcatcaaaagatttatcacctgacatgatacaattcctttctctctctttctcagaaacagatcagcagtttttcatcgaatcattatatttggtgttaaaaatgaatgaacataaaaaaaaacatgtattttaatccagtattcgtgttatggtcgaaatttcgtaccgttaaccta

SEQ ID NO: 677 - DNA, 937 bp, Leptinotarsa decemlineata
  Annotation=ADP-ribosylation factor 1; Tribolium gene name from OrthoDB database=TC012647; Blast E-value Tribolium Gene vs. Leptinotarsa Unigene=3E-129
ctattaagctttcaggtaacagcagttaaactattcatgatttccatttaattataaacttgtggcggttttgtggttatgactcttaacaattcgaaaataaccagaacaaatctaggatatgacctcaaggccaatacaacagaaaaacccttaattgcaacatatggtatcatcaacacgacagtacatgaacagacacagttcttcaactgcgattcacttgcacttaacggttggcgttcttcagttgattagacaaccaatccagaccttcatataaaccatccccgctcgtcgcgcatgttgcttggatgtaccagttgcggttacgtagtgaatgaagtcccagcttgtctgttatttcagctgcattcatggcatttggcaaatcctgtttgttggcgaagatgagaagtacagcgtctcggagttcgtcttcagccaacatgcgcatcagttcgtctttggcttctgtgatacgctccctatcattgctgtcaactacgaatattagaccctgtgtattttggaaatagtgtctccataatggcctaattttatcctgaccaccaacatcccacactgtaaagctgatgttcttatattctacagtttccacattgaatccaattgtaggtatagttgtaacaatttctcctagtttaagtttatataaaatagtagttttaccagcagcatctaatcctaccatcaatatcctcatctcttttttgccaaaaaggcctttgaataaatttgcaaacacattccccatagtgattgcttataacctctttttttccaaaaacacttcacactttcgagtaacgttaacacattcacctgtcctcccaaaaattgtcgaatgtcaatatggcggacgtggaagagaatcgcagttcgtgccacgtcttgggaaccagcatgtcgcatt

SEQ ID NO: 678 - DNA, 1152 bp, Leptinotarsa decemlineata
  Annotation=Engulfment and cell motility protein 1; Tribolium gene name from OrthoDB database=TC002742; Blast E-value Tribolium Gene vs. Leptinotarsa Unigene=1E-22
ataataatgagcagtaaattaaatattaaatcaaattttcattttgaattttgattattttattcattttattgtatttttatttcgcgtttaattgtttaatataattgatagtacagctattcattctaatcccatccgttctttcatagatttcgaatcataatagaatcatattagacaataaaagtctgaacttataaaattctaactattcaggaatattactaaaaaaaggtgaatgaaaatttcacattcgaatgtcatttaggatttgattcacctatttttagatattcttagaatagacggggaaatcttcacgaaactcagttcatccaagtaatcatcaatttgattatccaaaactttaacaataataattatcatttcatgtctattatgaatcaagatattcgtgaacgaatcataagacaacctaaagattttcagaaagaaaaatcaacagagattgattatgcttgggcttcgtgtagtccaaataagttaactgaaattttcttatcacatcactaatattaaattaaattctgtgtaacaaagtgtgatttggattaaaatctgccagttccagtgacgactacaattagaacaatcatagaaaatacagtaacagtaattaattccaactgtttaaattttttctgtaaatattatgtagaatatttttttcaaaccatgagaacgagcgccacacctaagggtctaactatgtaatttcaccagtttggaaacctaatacacctactagagttgcgtttcctttatataatgaaggcttaacgttaaagaaaattttaagaggggtctttcgaagattgctccctaaatgacaattgctaactattaccaacagatataatttgatgtcttattcaataaaaaacctattttagatcgtagcaaaaatggtaatgtggtggatcgggtggaataggtggaggatcttgtggaattgtgactccctccgcatccaataacctcaacttaatctccatactcaataatgtgtctaaatctttttcagtttccttactctgcattctctgtccgagcagagcaattgatgccatccgtaccagtaagccaatgccaacttcgtctggtgccacacaatctaaagattgcaga

SEQ ID NO: 679 - DNA, 1341 bp, Leptinotarsa decemlineata
  Annotation=Coproporphyrinogen III oxidase CPO/HEM13; Tribolium gene name from OrthoDB database=TC000466; Blast E-value Tribolium Gene vs. Leptinotarsa Unigene=0
actgatatgacacgataatgcggcactacctgttacagaaaaactacacaatacaaatgttcgctaaacagctgattatataggtcatagaaagaaaccgatttattttaactttttagtggttaatattttaaatattcgtcagaatcatgtatttcagagtaatcgtgaaaaactgttctcttatttattatcaaagacaacgtgaattttgtaagcttaggaaatatggtattgccttcactggagcccttgcctttttcacctccaaagaaaaaatcaacgccaatgaattcatggctctacctataacttctatagacaagctctctgcaaatcctgatgacatgaaaaccaaaatggaactaatgataatgagggtacagaaagacttttgcaatgctcttgaagtcgaagaaaactgcaacaaattcattgttgatcgatgggagagaaaagaaggtggtggtggaattacttgtgtgctacaggatggaaaggtattcgagaaagccggagtgaatatatctgttgtttcgggtagtttgcctccaggtgctataagtcaaatgcggtcgagaggtaaaaaactagaagagggggatttaccatttttcgctgcaggtataagtgccgtcattcaccctgtgaaccctatggttccaaccattcatttcaattaccgatactttgaagttaagagtggtgaagaaacccagtggtggtttggtggcggaactgatttaactccttattacctgaatactgcagatgccatacatttccaccaaactctcaaagatgcttgtgataaaaccaataaggcttattaccctaggttcaaaaaatggtgtgatgattactttaatattactcaccgaggagaaagaagaggtgtaggaggaatatttttcgacgatttagatacaccaaatcaggatgagtgtttcaagtttgttactgactgtgccaatgccgtgattccatcatatattcccttagtacaacgacacaaattgtcaaaatacacgaacgtagaaagagagtggcaactcatcagaagaggtcggtatgttgagtttaacttgatatatgacagaggaaccaaatttggcttatacacgcctggagcaagatatgaaagtattctgatgtctctacctttacatgcacgttgggaatacatgcatacacctgaaaaaaatactccagagcatgacctccttgaagtccttagaaatcccaaagattgggtagattgtaaatatgaagatgataagtaatgaaaacctattgcttttatttgtattattgtttgaaataaaaatccgttatagttta

SEQ ID NO: 680 - DNA, 3754 bp, Leptinotarsa decemlineata
  Annotation=Adaptin ear-binding coat-associated protein 2; Tribolium gene name from OrthoDB database=TC011619; Blast E- value Tribolium Gene vs. Leptinotarsa Unigene=8E-1; Blast E- value Tribolium Gene vs. Leptinotarsa Unigene=03
aaacaatgttattttggtatatttctagtcatatcaacaatgcatttcagttaaatggaatgttaggaaaactaccactaaacttttaaaaaacatattatgcaaatatatttaaaatgaaaaaatgaacacatgttctttccacctaaaataatagcaacatggtaagtatatataattaaaaatctcattgtcaatcaacatatataagtatcaacagtgcgtaaatttcatttcaactcaaatctatctattctaaaatcctttccccaactaattgaaatgtaaaacattgtccttattcaatagaaacaaatgtaattgctgacccttaaatcgaaatgttgtaatttggaactgaaactaatcaacagtttatttacaaaaaacttacatgtatataaatgccaattatattaaaaaattgtatatattgtgagggaaacaaaggatattatttttccatatccccgagagcaaaatctatcatattatggtaaacaagagaaggagcttgtgtatcatgaaacttcacaattttattggcaaacaaaaagattcaagtgaatgttaaaaatttatagtaattaaaaaaaaaaagaaattataaaaaagtccacctatctattaattaaactttataatagagttaattacaataacatctttaaaataaaataaatacaaaactaatcttgtttttgaaatagatcattcgcatattactaaatgatttgagtccaccttctgtatcaacatgaaaaacattttcaatctggatgtttcagatataccaaagttattctgataaaatatattatatttgctcttattcactgatctgaaacgttattcatttccaaacaacaaccattgtgaaatgcgattatatggaaaaataatacatataccctgttatgtacaaccaaaaaaaaatctatgataataagccctcaaggtgaacactaaactgatggaaaattagaagaacgcgattatgttcgaaataatatagacggtcgaataactctataaatttaaatttacacttcagtcacactgaataattaagtaaatcaaattaacacattttaattccgagttaaaatacacctatcatcaaatcctattagaggaatacatcattgtttcacacataattttttctacttcaattcataaaacaaatacttcttgttctatttccaattcataatatacattatcatcgcttagatatgatttatttttcaaagtaattaagttgatatcatgacaaagaaaaatgtatttgaatcacatttgaaatttctatagatttactggttccatatactccatctgcggatcacacaaacaattagcaatcatgtcacagtgtagatgaatgtgctgtaatatgtgttaaatacttagtggtaattaattttcatctatgataaactgaatcacattgaatctttcttactcgtttaatgctcatatctttttggtcacgaatcatggtccttttttgaggatttctacatcaccactataacagggtattgtaatgttatatttttatatcaagagtcacaaaaaatattattcaatagttataaattcaagctttttgaacataattctgtatattgaatgaacttatgtgatttcaattcctattaatttgatcttttacaatctagaatcgaaattctccccaagtgctggtataaactttaaaattgtgttttctataattacaaatgggcatgttcacactacaacgaatagaacatcatgacgaaagtgatgataaggtctgtccataatgtagatgtccttatgaggatctgtcattccttttttagttagtggagtcaatgttatctgttctagggcaagtctattctatcaagtctatgaaaattaattttcagtgacaaaattctttgtcgatataaaggagtgaaaaaacaattcgttacatctgtattcaagcaagaagttttcaaacaattgaattatggaaaaagaaggacttgaaaactatgaatacaaaaattcccagacaaagccaaattttgagtggaaaaaaaatacttaaaaaacttcgatggtagtaaaaatgacaggttaagaaataaaaaaattaaaaaaggtttcataagtcgcatcatgtttccacatgtaatggaaagattgttattgtcattgtaaaaattcacagtgataacattttttttatttcaaaaaacaaactacagtactagagatcttaaaaaactatttgaaatattcacctctagggtaactatactttgagagaagcaataaggtgccatgggaatgaaaaacggattcaattaatgaaattaattttatcaacaacacagtaatgttgtaccttgacgtctcaatattacctgtgctttctgtattgaagtagaaaaatattaatgcacccaaagacttgaatatcttcatcaacccaacaaccagaaagtgataatcaaactgttggtgaactgcatgattcattctctcaaaatctcagacgctagtgtccaaacagtgtgatttttcataatttggttggaaatttatcttactttttatgtatccaactaacactacaaaaaattacaaatgttcaataaaaacataatctagtttagcctgggagctcagagagtgaatcaccctgttcgataatattaaattgcaatccacatacaaatctatcatatctgagttttacgtggtggtacaatagagataatacaatagtacaacatacctaacctagctgaaatctaaccagatcacagtgagacaagtaagaacttgtcttattttgatacagtcagtacttcatatttcttttcatcataactcttcaactaaaactgcacccaattactatttgttggaggttgactttgggatggagcactatttcctgcagaggtgaattctccccacgaatctgcagtggcattatcacctttagaagcatgagctggagatccagcaggagaactaccaggcggagcaggtagtttacctcctggaggaggaggcaatagtcccaagcctccaccattaccagactttacttttgttcttgaacttccttcagagccatctttcttagttattttcatatttattttaattgtttcaccttctttaaaacctaagtcaagtccaggtccactggcaggctcttcattgatctgtttctccttcttaacccacttgaaatggtcctgaagtgctacattcaaatcgaacgaatcagatctatctccaaacccgactccaataaatgcagatcgcccattatcatccattatacgtagaacaaagtaacgtgaggaatcattcacagattcgattgcaatactaggatatgcatcaataggacatttagcaaaaagttctccagtattccggtcttcaagttttattgcaagatcattacctttcgatatcaatcgcattcggcctgtccatgctggttcagctaagttccagtcagcagccctgtaacctctattcgtcgatcttggaggaatgttgaatacgaaaatttctggtttaaccagtaaaacgctttcataactatccattgagatgcacaaaatctttatacctaaagacctcttcacgaaaacaaataaggtaccaaagctatttcaacttctcccaaacaaaatttttgttgaaaatgtcaaaacataaaaatttcaattctcaattgtcattc

SEQ ID NO: 681 - DNA, 1158 bp, Leptinotarsa decemlineata
  Annotation=Nicotinic acetylcholine receptor subunit alpha2; Tribolium gene name from OrthoDB database=TC001432; Blast E- value Tribolium Gene vs. Leptinotarsa Unigene=6E-89
catatatggctaccagatatagttctatataataatgctgatggagaatatgtggtaacaacgatgacgaaagccgtcttgaggcatacgggaaaggttctttggactcctccggctatcttcaaatcttcttgtgagattgatgtgagatattttcctttcgaccaacaaacttgcttcatgaaattcggctcatggacctacgatggcaaccagatcgatttgaaacatatcaatcaaaaagtgggagaagataaagttgaagttggaatcgacttgagagagtattacccaagcgtcgagtgggatatcctgggagtaccggcagagaggcacgaaaaatattatccttgttgtgctgaaccctatcctgatatcttcttcaacatcacattgagaagaaagactctcttctacacagtaaatctcatagtaccttgcgtcggtatttcgtacctgtcagtccttgtgttctatcttcctgctgactctggggagaagatcgccctgtgtatcaacatactgctctcacaaacaatgttttttctactgatatcggaaatcattccatcaacatctttagctctaccgcttctgggaaaatatatcctcttcaccatggtcatggtagggttctcggttgtgatcacgatcataatactgaacgtgcattacagaaaacctagcacccacaagatggcgccttgggtgagaagtttcttcatcaagagcgtgcccaagttgttactgatgcgagtgccgaaagaccttttgactgaattagccgccaataagatttcaatgaacagattgtccatgaagacaggaaatatggataccatgccttctagtagatcgtcgtcttccagtacgtccagctcatctatgaacagacctagtgggtgtaatggcttacactccacaacaagcactagattgagaggattcgctggaacactgagtgagaggctgggatacaatggattaccatcagtattttctggacttgatgaaagcgactcgggaacaaggaaaaaatatccgtttgagttggagaaagctattcataatgttatgttcatacagcatcatattcaaagacaagatcaattcaatgcggaggaccaagactggggttttgtagctatggttttagat

SEQ ID NO: 682 - DNA, 2558 bp, Leptinotarsa decemlineata
  Annotation=Vrille; Tribolium gene name from OrthoDB database= TC001609; Blast E-value Tribolium Gene vs. Leptinotarsa Unigene= 5E-92
tttttttttttttttttttttttttgtttttaaaaacgtatgcaaatatttattcagtattttcaatacatatttaggatacatcaatctgtaatatgaaaatatttgatagtttctttataatatgaatataacgtttattctggacaacctacagattcacataattcaattaacaaaaaaacatcatgttttgaggcgaggtccagcaagttcgataatgatacaaacatttttcagtaattactaggaattgatcggtaacaaaatattgataattaatgtcatatgaaagtagtacatgctggacaatctatagattcatataattcaattaataaaaaatacatcatgttttgaagcgaggtccagcaagttcaataccttcgataatgatacaaataggtttcagtaatttctatgaattgatcggtaacaaaatattgatagttaatgtcatatgaaagtagttcattctggacaacctgcagattcatataattcagtggacagaaaaaattctgtttgaggtgaggtccagcatgagtcttacgatatatatttataaatatataataatgagataacgtaacgtaatattaaccgccgttgttgcacagcaaataacaaaaatacatacatttttacataatgataaatagttacaaaaatcacacatattttcagctaataattaaggtaggtacattaatccctatgataaaatgacgaagtaaaatcggttgtgatgatataagacagtacacaaaactgtacataaactgtactgtacagcacataaaactgataacatgttaagtcatatctaataaaagcgccacagatacgcaaattaattttacagtaagataatcataggaatatattggcaaaagaaagcggaacttgtgcaaaatgaaatatcaagtcttaactaacaaataaatacctatcattaaataaatatgctcctttggagcacgatatgtccaatctccatcaaaaggatcatcacaaaatcacagaggctgcttggcaaccacttcatcacatcaactaagctaatgttggggagcttctttgctcctattcataatggtcttgagatgctccacctcagaagaaagtcttatcagttcagactgcagtctatgtttggtgcttgcgtctccttcagcggagtcttgcatgagttgaagctgggactgtttcagagtctgaagcgtagctgcggctgttgcagcagcagaccattcagcgcccaatgaaatgccggagtctctctcatcgctggatccctccccgtcccatggagggctagctcgaggacctggctcttgcttgatattctgcaaggacagaagggcactggctgcgtctttatcgccaaggtgggatttgtgtctcagcttcaatggcaaactgttattgggttcattgatggtcaaggcaatgggaacgctctcgtctcctgagttgctggacacttcgaaaggtgactgtaccctcgatctagatctagagagattcagagcattgttggagtcgtagtggataccggaatggtggtagaaagggtagtggtggtactcaggttctctgtaagcaggttccatgtgcgatgctgggggtgggtggaggatgttgtgggggtgaggcataggctgtggcggtggggaacccatcactggctgatgtataaccgaagttggaatcgggctgggtgtcccgaataaaatcgggtttggtggatggttgattttttgtctcttggataagctgagaacctgctcactggacggtaagtttgctagaaccttctccacacaaaccacgttttctccgcagatcccgtactcttccttgatagcctccaactgagctttgagtatagcgttttccttggtgagctcgatgacgcgttgctcaagcaccatgtcgttgtatctccgtttctctctggacctctttgccgcttcgttgtttctgcggcgtcgatcccagtagctgtcgtccttcttgttatccggggtgaattctcgctgcttgcgctgcgagaacagatccttatgtttgactgacgagttgtagttggggttgtagtcttctgcaggtgtggaagacccagacagcatttcccgtccgtgactggctggcatgttggagtttaaatgtggaatttcaccatttacgggggaaccactttgaccgcggcccacaaattcggcaaccatgatctgctgttttaggacatcaactaatctggtcgacgttgtagaatcctctgctaactttcgaataataagcactgtttcaaacaaatgaaactgtcaacaattatcaatcacacaacaatagcgcagcacacttgatacaaaaaaccacgtctgtactgagcgaaagatttgaaataactgcgcgctcctcgcgagttgtcagagttaaacggagatacaacgacgcgttgctcaagcaccatgtcgttgtatctccgtttctctctggacctctttgccgcttcgttgtttctgcggcgtcgatcccagtagctgtcgtcc

SEQ ID NO: 683 - DNA, 2998 bp, Leptinotarsa decemlineata
  Annotation=AP-2 complex subunit sigma; Tribolium gene name from OrthoDB database=TC009991; Blast E-value Tribolium Gene vs. Leptinotarsa Unigene=1E-92
aatcagtgatatttgcaaatggctgaagatgtcataaaaaggatttggaatgtggtacacacacataatttctttcgagatacccccaactctgcaaacagcactacacaatcaacaaaaccatcctgaacacaagcagaaatattgtacaaattttgtttgatgcaactggaatgtcattgttggctcattatattgtttaatgatggcatacacccaagatatgagatgataacacttttcttgatttcataactaatttgagtatcatataacttaatactagaaataaaatatctatctagttcgaatataatacacataagatgcaaaactgtttccacataggccgttttaataaacactgatgaattttttctgaaagttatttagtaatttccctttgagttgtagataatttcagtagatttaatttggaaatattgtttgttcttaatactaccacagtttacttcttcaacataaaattatctgacttttaaaaaagttaagaaaaaaatttttttcaatgtaatgatcttgataaatattatcaagtgttattttgcacaaaaaattccaatatagatgtaactgaaaaatataaattagtgtgaaatgaaacctactgattttaaaaaaactaataaatattatatttcttatagaaagtaaaatcatttcaccgaaaatgattaaaattcatttacaattattattaaaacattttgaaaaacatcaaagagcctatgtgaaaactgcaggtattattgacagcataaaaaacaaaaactgataatgatgaaaatctatattttggctgaaacagcaatatattctgaaactattactcaggaattaaaatgttttcaatgctgccaactattcgggaattcagggttcaatatttgtaaccagtacacgcaggatgatctgacgaaaagatagaggtcattacgaaatttccaccttagaaacgaaagtgaaattcccttaaaaattaatcattgatctgacaaagaggcagggaaatctttgcaggcaataaaaattgtatagcttgcatgcatacttatggtgaacatgcttaattcagattttaacaacccttctataaatttttgaataaataaaagatataaaaatatgaaaccttaggccaaaagccttcttctgaatagaccgttaactgaaaatgaaattaggaccaatgctaaaagattaaataagaaatattttctcaaaaactcttttttacacattcaggaagggtggtactctcaaattcaatcagaatgttgtaagagaaagagacaaatagttcagtggtatgaatcagtacatgacaatgtctagaaaccaaaaaacaaattgaattttcttaatgtttcggaaactttttttttctaaaatgagtccccatctgtaacaaagacttttgatttttattcaagaaacaatttgttgtgaaattttcactaaacagtttcacaaaactgtgacaaaaagtatttcgctatacaatagcttcttcaaacgtgtctatactaaattcatttttattgttctgtaaaaaaataaactatactgccacccttgattgaataaatgtataaacaaaaatgattaattatgacgcagaaattttgggaactttaagtttttattagctatctgtgtgtttttttaagacatataagtattacgcacatgaggttaagtggtagaacaaacctgtactgttctacactgcaattttgaacttcaccttttggttgttatatcctatatcacccaataaagtccattactattattattattatataagaaaactaccattctttgaaaagcaaccttttaaagatcaacaatttgtctactttcagaaaataagtgattagaaaggaatctactatagaaattttgagaaatatgtaggttgttaatattccagaagaatatggaagtttgtgaaccaatttgtaatttcatcaaccaagttcagtgaaatttagtacaaattacaacagtataattaatcatgtcttagttttcctctcagattattaaattctcaacaaatacttataacatgttgataagagaagttgtgtatccagaaggtttctcaaataaaatttatgattcaaattgaaccttctatccctattaccaaaatatatagaataacaacagaatatatgatgtgactcaaacaattaaattgatatgttttcttcagataaatattacaaatattcaaaaggaccgttgatctactcatcagatcaattacataatctcagtttatctttttattaatatgcagtaccttcaggaatgtaaagcgataaataataaaaccgaagcagattccatttcacctccactttcacgcagatcatcttgacgtttcactcaccctgtatgaaagttacagatgtaatttttcataaatttataatattattctaaagagttcaacattaacaactgtttcaggactttcgtttgtgatgtttcccttatttctcctgccaaaaacatttcgtcaacgacagtataaactttataaaagttgaaaacaagatctaattcacagacattgtggaaatattcattgagcacctctacaaagttatgtattgcttctaaataacataaattattgtcgttcacatctacgcatatgcagaagtacaggccagcatatcgtcgatatacaattttgaagttacgaaactcaacaaaattcgtatgtttggcatctcttacagttactacagcatgaacttcttcaatgagtttctgtttctcatcatcgtcgaaattcatataccatttggctaatcttgttttaccagctctgttttgaatgagtatgaagcgaatcattttccaagatgatttataacttgttctttgatgttatgaagatttttcaaaaacttataccctaaatatccacaaaattttgtgctaaatatcttcaaaa

SEQ ID NO: 684 - DNA, 4957 bp, Leptinotarsa decemlineata
  Annotation=Tyrosine-protein kinase shark; Tribolium gene name from OrthoDB database=TC004153; Blast E-value Tribolium Gene vs. Leptinotarsa Unigene=0
tttttccagtcattattgtgtggttgtggtttaagtgtcattcatttttcatttgccattgttataagttttgattttcaataaatgattttgtagtcttgagtgaaactgaggtttttatatgaatattaaatgtgcacctccctgactaatagaccatgattaacagaccatgaataaaataaacaacaattatgaagatattcgctggtatcatggaaaactatcacgggaggaaacagaaagggttttgctacaagatggaaggaagaatggattgtttttagtaagagaaagcaactcctctacaggagattatgttttatcagtgcttcataatgaccaagtcagtcacttccaaattagaaggcatgctgaggatgcatttttttcaatagatgaatgcctgaaatttcatggtctagaagtgttgatagaacactacactgttacaccaaatgctttaccagaaaacttggtccttactgagtatgtggtgaagtatcctccaccacatgattcgagaagacacggaagaacaaacttactgcatcgagccactgaccagggcaattatactgtcgtttctgaattattgaaaactgactatccacatgatgccaaaaaccaggaaggacaaacagctgcccatctagcaagtatgactggaaaaaatgatattttaaggaaactcattgaatcagatgccagtgttaatctaagagattctgcagggttcacacctttgcattatgcatgccaaaataactttccctctactgtgagacttctagttcagttaggtggtgccaatatccaagcaagaaatactgaaacaggtaccgtacctttacatgaagctgcaaatcgagggcataaagaggttgttaaagaactgttgagtttaaatgcccctgccaggcctaggaacaaaaacaatcttattcctgctcagctggcgagaatgaacaagcatctggattgcgctgatattttagataaatataagtatacaacaaaaacgtcgaaaagtgagtggtaccatggcactttggacagacatgaagcagaaacgataattaaacaacataatacaaaaaatggtgcctatttagtgaggtttagtgaaagaaataaggaatatgtattgacattgttctacgaagatattttttataattatattatccacaatgagaatggttttttgtttatcgatgatggaccatatctagattctgtggaacatattgttgaacactatagcatgatgccagatggattaccaacagtattaagagctccagtgcctccaaagccaaaacctccagtgccagagttttcaacgatgccaaaaccaaaacaaaagaatcaaaaagttcaatccaacgtagtaccaaaacccgatgagaaggtcgctaacaaacatttccagagtttaaccttcacaaatgacctaattcgtacaaataataataatgtctcagaaaatgagaacgattgcattccagctgatcgcttgacaaaaggaacccttattggcgaaggagaattcgcatctgtatatgaaggtacttatttgagaaagaacagagaacgaactaaagttgctattaaaattctccacaacgaacaaatggaaacgaatcgtgatgaatttttgagcgaggcacatcttatgatgaaattaaaccaccattgtgtcgttaaactcatagggttgtctctaggaccacctcttttgatggtccaggaattagttcatctgggatcgattttgcagtatatcgaggctaataaggatggaatcaatccgaattatgaatttaaaatatgggctgcccaaattgcatgtgggatgcaatatctggaagaaaacagatttgtacatagagatttggcggctaggaatattttattggcaagtcgtactcaggcaaaaatcagtgactttggcctttccagggcattaggagcagggcgtaattattacagggcaatgggtggtggaaaatggcccctgaaatggtatgcaccagaatcatacaattatggtcaattctcccataagagtgatgtttggagctttggtgtcactatatgggaaatgtacgcttttggaactttaccttatgaagacatgaaaggatatgaggctataattttcattgatgaaggaaagcgattggagaaaccagtggaatgtccaaacaatatatacaatatgattcgtcgatgctgggagtacatggccgatgatagaccaacttttgtagaacttgtcgattttttcacatctgacattgaatatataaacataaaagaactcttgccagaagaaaatttggcgtaattttttcatggtgccaatcgttaatactatgtgatcatgggtagatgcaactttggtgtgtaggtcatctgttaaaactcatgatgtttgtgccttcaaatataaatgtctatttttaaatttctccaagatacatacgtagttgttaaaagcttatattgatgggtattatttgatatattttccccaatctatttattatatatctgttttataattggcattgcccaatggcatcaatggacattaaattgggtgaagggaaaaaacatctatacctgttaaatatttttttttattatgaaaactgttgaaatttacatatcagaatatatgttcaaataatctagtgctgcaattgaattggaattgaacacttattttgaaataattgttattggtctgtgataaaaataatacattttcatattcaaaagtgacacaaaaatttttgtatcaacaattcactaattatggttattgctcacttatattattatgtaaaaatataagtatattgaaggtagtgtaatttttgataaatatatatttagatatattccacttctgcttaggcttcattcagttaacagggaagttggaaaaataacataacagcattataaatgacattccatagaaaaaaaaatgttgaaatttgaaacaatttgaatataatttttaactaaacgtaggttgacattatgttgtaatatttttatttaatttcgtggtcatttactcagattcatttgaagtttttaacaaatcaagactttcaacttgtcatgtttataatttttaaacttgggcaaaaagttttggtatttacaagtaaataaacattaaaattttcaagtatgtttcactaaggcttgaacgaaatagaattattgattctgcaaagaaaattgaaaaatatggaacctacataaatttattagtaggtcagtttttagttgtgtctaacaatgggagaaatctctagtcagatctccagtagatagcagtttgctgaatattttttacattcaaataaatttttgtcatatttgtatttccagtatttacctattttaaataaactatttttgtctttgtctatttgtaattaaacggtaaatcctttaaatcgactaggcagtagtgatccacttgaccacatcaaatttagtttattcaaagtaatcaaactgcattgaatcattgaggtcaattgcaataaaatataatattggatacaaccaattctagggaaaaatctcgttcaaactgtggtagaaatgcactattgacatcgatgacaagtgacatataaaattgaactgaaaattattgtttttttttttccaaagccatatttgacaggtattttttctagtgtaaagtttcaagctctggttgcaaaaagctcaaggtacttaaaggaataaaactaatgcactatgatataaagaaatagcctcccagacaattatttaacttaatcaaaaatcttaacatttgctcaaatagtagacccgtaatgaaaccatgaacaggtatgttaaggctaatggtaacggagtactattgcatttgatccgtaccacattgaagcatggcttatattaatacgctcctacaagccgaataacctgcatgcaacttaatttttcatcttattcagttacgttacagaataattgatacagcaaaagctcaaaatgcttctggaagcaaagaatgtcatttcacaatggaccaaaaatgtatcacgttacattacgggctattgactcatatagataggagactttatagtttgcagttctgagagaatgaatgacttttcaaatcattataatctgtgaggtttcgatagaaatgaagggtctggtgaaaaaaattatgaggtcttttatattttgtcaaatttcagtggcatctgttgtctagtgagatgaagtatcaacaagcccaatagctctgggaaaactactaaaaatcatgtttgaacattttttgcaagaacaaggcgatactcatgcacccctaggattcacgttgcgatttcacttcctctcttcagtctttcctcatttcgagtatccttccttctactagttcctgtcattatgacaactttattctcatcaaatttaagtttgctcttgtttattatatacaacgaaataaacactgttctgcatgcagaaaaaactctgaagacttgaaacctaagatttagtttataccagaatctgttaaaatggaacctcatcgttcttccactgccccttaaaatatacatcaataatattttaacattttccagtacctaagaactaccacaatttgaaaagtcgattgagtatcaaatggatcgatgctgccaaattgaacaaatatttaggagttataatcatgatgatttattttttgtatttctgaaaactgagactctgaaggcatttattgcgcaaaaactgattgaagcaattttatatctaataattatatatatatgtttatttatttattcgttgttttccttgaaaccaatacatttatacaaagatcctggatatattatatttattaatcaatcttttcaatgctgtc

SEQ ID NO: 685 - DNA, 1894 bp, Leptinotarsa decemlineata
  misc_feature (1838)..(1838): n is a, c, g, or t
  misc_feature (1856)..(1856): n is a, c, g, or t
  misc_feature (1860)..(1860): n is a, c, g, or t
  misc_feature (1863)..(1863): n is a, c, g, or t
  misc_feature (1866)..(1866): n is a, c, g, or t
  misc_feature (1868)..(1868): n is a, c, g, or t
  misc_feature (1871)..(1871): n is a, c, g, or t
  misc_feature (1873)..(1873): n is a, c, g, or t
  misc_feature (1875)..(1875): n is a, c, g, or t
  misc_feature (1877)..(1877): n is a, c, g, or t
  misc_feature (1879)..(1879): n is a, c, g, or t
  misc_feature (1881)..(1881): n is a, c, g, or t
  misc_feature (1883)..(1883): n is a, c, g, or t
  misc_feature (1885)..(1885): n is a, c, g, or t
  misc_feature (1887)..(1887): n is a, c, g, or t
  misc_feature (1889)..(1889): n is a, c, g, or t
  misc_feature (1891)..(1891): n is a, c, g, or t
  misc_feature (1893)..(1893): n is a, c, g, or t
  Annotation=DNA double-strand break repair Rad50 ATPase, putative; Tribolium gene name from OrthoDB database=TC011011; Blast E-value Tribolium Gene vs. Leptinotarsa Unigene=4E-49
atatatatgttttgattcacctttattctgtagtttgaaggagaaagtgttttgtgatttgaaggtttgaagtgtcggcaaaaatggaagaaactggtgatcgttttgtgatcgtgataataagaattttctgacagcgtgactcatttcattgcgagaaaagttcctttgaatatatgttttcagaggtattgatctatatttgaaaatattgtgtataatggctgattcacgtctgagaaccatcaaaatcaaaaccggcgtggtaaaaagattggcaaaagaaaaaactgtatatgaactagaagcagatcaacaaaaaaaccgcattgaaaaactgaaaggtcagggcaaagatgaatatgaaataaaaaagcaagaagaagttctgaatgaatgccaaatgatggttcctgattgtcaacgtagacttgcagttgcttttgaagaattgaaacaaatccttgaaactgaacaggacttaaaagaggatgaatcctacttaactgcacagaaagttttggaagaagccaagttacagttgcctaaggccagtgaactgcatatgtgttaattttgaagtgtttctttcagtaaagacaaatactaaatttttataatgaactttttaaaatatcaaaacttttctaatcgtagtgttaatcttgaggtgtcggttataacggatcctaggactaatattttgcaaacgctgtacagtcagtctaatgatgagctgtggatagattcatggctgcagcaaaataatatctatcaccctattcctaaaataaagataaacaaagctgccaatgtgatctctatcagtgatgcccaatcttctctcaaagaatgcctcatgctcatggagaaacttacaaaaacccaacaagatttacatgataatgttgacaaaataccctctgaagaatggaagcagaaaactattgaaatcggccttataaaagatcagtttaccaagctcatatcaaagtttgagagcggcgaagctgtttttgctttgaagaaagccatcgataaacgaaagaagaaaagattaaatctgaagagaaaaaaagaattcagaaaacaagaacttcaggaaaaattccaaaacagggagaagttacataaaacgattgatcagtggttgagaactaagatggaagaagtggacaaagtgaaaatggaagaggctatgaaaaaagatgctgactgtgtattggctgaagttacaaagaaaaaatcagatgccaggaagcagttagccttagttgctgctttaacaaaactgcgatccattagagatcaaatcgccactcaaagaggggaaaaacgatctctggaggatgaaaatgcatttaatataacaacagcaaagttgaaaaatatgtgggagtcatctcttagaacgtacaccattgaggagcaaggtttgaaactgatgttggagaaaactgcaagcgaggattccaaaactgctcgtgtgaagaaagatcgcaagctattggaggaatggcacgatatactttttggacctaggcaggttataccgccagagaatgccacctattgggctcttacgtctgctgagagggaccttgatacatttattgcgataaggaggagctgggatacgtttttggtttctcccacaaatgaaatgggttctaaaattcctattgggtgggctcttccagatgttgaggctgatgaaaattggactaagtatttggcaactgtttaatttattttgaatatgtatttgcttatttgcttactttttaattaaaaataattttagtaattaaaccaaaaaaaaaaaaaaaaaaaaaaanaaaaaaaaaaaaaaaaanaaanaanaananaanananananananananananana

SEQ ID NO: 686 - DNA, 1087 bp, Leptinotarsa decemlineata
  Annotation=ATP-dependent transporter; Tribolium gene name from OrthoDB database=TC013884; Blast E-value Tribolium Gene vs. Leptinotarsa Unigene=0
gcactctgtcaagttccatttcgtggacacatgtgaaattatttgagccgattttatttttaggaattcaattgaataagccaatatgccatccgacgccaaaaaacgtgaacagcaaaagaaaaaagaggccgcgaaggctaggcaggctgggaaaaaaactgagaaacctaaagctgaagaacaaagtgaagctattaagaccaatggacaagtgaatgggatttctaacggatcaactgaaatgagcgcagaagaggctctttgtgccaagttagaatctgatgccagactaaatgcagaggctcgagcttgtaccggttcattagcggtccatccaaaatcgcgagacatcaagatcgacacgttctccatcacgtttcatggttgcgaaatgttgcaagacgccttgctcgagttgaactgcggtcggcggtatggcctgttaggtctcaatggcagtggcaaatccaccatattggctgtgttaggaaatagagaggtgcctattccagagcatatcgacatttttcatttgacacgtgagatgccagcctctgacaagtctgctctcaagtgcgtcatggaggtagacgaggaaagagtgaggttagaaaaattagcagaacaattggttgcttgcgaagatgacgaatctcaggaacaactcatggacatttacgagcgtctcgatgaaatatctgcggatacagcagaagcgagagctgctaacattctgcacggtctcggttttacaagggagatgcaaaataaaaaaactaaagatttcagcggaggttggagaatgcgtatcgcccttgcgagagccctgtacgtgaaaccccacttgttgcttctcgatgaacccaccaatcatctggatttggatgcctgtgtatggttagaagaggaattaagaaattataagcgaatccttgttttgatctcacactcacaagatttcctgaatggcgtttgcacaaatataattcatattaataaaaaaaggctcaaatactataccggtaactatgatgcctttgtgaaaactagaatggaactcttggaaaatcaaatgaagcagtat

SEQ ID NO: 687 - DNA, 1445 bp, Leptinotarsa decemlineata
  Annotation=RGS-GAIP interacting protein GIPC; Tribolium gene name from OrthoDB database=TC011711; Blast E-value Tribolium Gene vs. Leptinotarsa Unigene=2E-158
agtacctctatttttttttatttcacgcaataatatctgaagtatggttactgtgaaacaattgacagttgaaatgtcatttttaacacttatttctttttttaacctttctctcgtaatagtagatacaattttgctatacatatttcattatttcatatcaaatattggactggctcacaccttgcatatattatcgtatattccctaacaaaataaacacaaggcgcttatgtgggtattcaaatattaataatacaataagtagtcgacttaaatattgcaacaataaacatcctggcacttatttgttcaatttaatcttccagctctggcatctgtaattaccccccacagctctatgatgagttcatccgtgaattcaaacgatgcgaggtcggagtcgtcgatggcttctgcgaaatccatggaattctcttttcctttagacatatcccaaatttggttagcgagttctgaatcattgattcccatgaacgattccagaatattgttaattttttcaatgccagtatctagtgcgtcatctctttcttcgatttccgcttctccaccggccttgaacctcaaagtctccctgccgctaccataaattttcttcccagaagaccctcttccagtattaggtgatatgctgctaaatccgctcttcattggttcaactaatcggattgtgaaagtggttcccttggggatttcttgcagagctttggctacttcgaagtgtcgtttacctaccatattttcaccgtctaatttctctatgtgatctccaacctgtatgtgtgatatactgtgaataatagatccttcttttattcgtttgatgaaggagtatcccgcaccgttgtctgtgattgtgagccccaacgaatcttctgatttcactaattctatctcctttggtctaccttttttatgtgcaaatatgaaatcttctaatcctatttggccggctaataattttttcatgtcgggcttgtatgtgttaagggtgcaaaataatatctcggaagcgggtataccgaaacactctgcaattttttcgtacagctcccggacgttcgaaaatcctgaaacaaacgccgttgggctcccgtgtgctagctggcagtagaactgaagggaatttttcgaaacgggagatacaggtgaaacaggtggcacattattgttttcgagatgcgtattgccgttttggggggccggagccgattttgggcgatgttttctgaacatttttcagtctgttacgcggcgcaaaattactgaacaattacgaacgccaaccaaacacaagtgaagtggacggatatcattacattgttatcactagctgataacaggttttcgatgattttaattttccattagaggctcgcgcagagttcactcgcgatatttctacagctccgctgcgattc

SEQ ID NO: 688 - DNA, 3075 bp, Leptinotarsa decemlineata
  Annotation=Coatomer subunit beta'; Tribolium gene name from OrthoDB database=TC013867; Blast E-value Tribolium Gene vs. Leptinotarsa Unigene=0
gtcgattgtcactttgatgtccatctcttgacacgcaattatttgttaacatcattgaattgatattcgaaattaacgaaaacctgcaagggaaatggttggtacatgctgaacatatcaaacattcagggattcgcttttttaacactttttgattggatctagtgcttttttccttcgccttctagtacttattttaaaagagttgcggcaacaccgattgtgatggttgatatttgctgatgtgtttataaattttttgtattattaagaatatcggaagtaaaatgcctcttcgtttagatatcaaacgaaagttaacagcccgttcagacagggtaaaatgtgtagacctccatccatctgaaccatggatgttatgttctttatatagtggcaatatcaatgtttggaattatgaaaatcaacaacaagtaaaaagtttcgaagtatgtgacctgccagtgagagctgcaaaatttgtcccacgtaaaaactggatagtcagtggatctgatgatatgcagataagaatattcaattacaacactttagatagaattcattcctttgaggcacattccgactatgtgagatgtataatagttcatccaacccaaccttatattctgacaagtagcgatgacatgctcatcaaattgtggaattgggataaggcttgggcttgtcagcaggtctttgaaggccactctcattatatcatgcaaatcgccatcaatccaaaagacaacaacacatttgcgagtgcttcactggaccgtactttgaaagtgtggcaacttggagcatcaacagcgaacttcacccttgaagggcacgagaaaggtgtcaactgtgtggactactatcacggtggagacaagccatacttgatatcgggagcagacgatcggttggttaaaatctgggactatcaaaacaaaacgtgtgtccaaaccttggaaggacacgcccaaaacgtaaccgcggtttgtttccaccctgaactaccagtggctctcacaggcagcgaagatggtaccgttagagtttggcatacgaatacacacagattagagaattgtttgaattatgggttcgagagagtgtggaccatctgttgcttgaagggttcgaataatgtctctctggggtatgacgagggtagtatattagtgaaagttggaagagaagaaccggcagttagtatggatgccagtggcggtaaaataatttgggcaaggcactcggaattacaacaagctaatttgaaggcactgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcgaatattcaaaaacttcaaggaaaggaagaacttcaagtcggatttcagcgcggaaggaatatacgggggttttctcttgggaattaaatcggtatccggtttaacgttttacgattgggaaactttggacttggtgagacggattgaaatacaaccgagggcggtttattggtctgacagtggaaaattagtctgtctcgcaacggaggacagctacttcatcctttcttatgattcggaccaagttcagaaggccagggagaacaatcaagtcgctgaggatggcgtagaggccgctttcgatgtgttgggggaaatgaacgagtctgtccgaacaggtctttgggttggagactgtttcatttatacaaacgccgtcaatcgtataaattacttcgttggtggtgaacttgtcacgatagctcatctggaccgtcctctgtatgtgctgggatatgttcctagggacgatcgattgtatctcgtagacaaagaattaggagttgtgagttatcagttgttactgtctgttcttgaatatcaaacggcagttatgaggagggactttcctacagcggatcgtgtcctgccttcgattcccaaagagcatagaacaagagttgctcactttttagaaaaacaaggcttcaagcagcaagccttagcggtgagcactgatccagagcatcgattcgaactcgctgtagccctggaagacctcgataccgccaaagtattagcccaggaagccaacaatcctcaaaagtggagccaactagcagagcttgcggcgtcaacaaataatttacagctagcaaaagagtgtatgcagaaggctcaggattacggaggactcctcctcctagccaccagttctggagatgaacaactagttcagagcttgggagaactcacgcaagccgaaggaaagcataacctctccttcctttcttattttctggtgggagatctgccgaaatgtttggatatcttggtcagtacgggacgcctacccgaggctgctttcttcgcacgctcgtatctgccggacagaatatcggaaattgttgaactgtggaaggtgaaactgacgtcaattaatgagaaagctggtcagagtctggcggatccgaagagctacgagaatctttttccgggtttgcaagaagcgattgaaacgcaaaagtatttggagcagcaggatagggggcttttcccggcttccgtatcgacaacgatcgttcccaaccatgaaaggaatttggtggcagaggcacgggcccagatgaagggtggagctgcggtttctcagcaaagcaggttactttctggagaaaaaacaatatcctttgaacaggatgaagatgatctagacttagatttggaaggcgttaatattgacgacaatatagacacaacggatatcaatatcgacgatgatttattgagcgattgaaattggccattcagcgatggaaattgtgtataaatttttataaactatagttcccagattatattgatttattattcaactaattact

SEQ ID NO: 689 - DNA, 1361 bp, Leptinotarsa decemlineata
  Annotation=ADP-ribosylation factor-like protein 1; Tribolium gene name from OrthoDB database=TC008443; Blast E-value Tribolium Gene vs. Leptinotarsa Unigene=2E-1; Blast E-value Tribolium Gene vs. Leptinotarsa Unigene=06
aggcaaaccggtcaaacacgtcatccgtcaataaggtggcctgataattttagacttcaaataaaattgaatctctcgcataaaatatcaataaaataatatgtatcagtgacacgcatagctttggttgcgttcagaaaaagtctgaagaaacttccagaatgggtttgttattcagttatttcaagagcctgataggttcccgtgaaatgagaattttaatattaggcttggacggtgctggtaaaacgacaatattatatagactgcaagtaggagaagttgtaacgacaatacctaccataggcttcaatgttgagcaagttacctaccaaaatctgaagttccaagtttgggatttgggaggtcaaacaagtattaggccatattggaggtgctattatagcaatacagatgctattatttatgtggtagactctgccgataaagaaagaataggtatatccaaagatgaactggttcccatgctaagggaagaagagctagcagatgccattcttgtagtcttggccaacaaacaagacataccagggtgcatgtctttgaaggaagtgcaccaggcactaggtttagaagccctcaaaaatagaacttttcagatattcaagacatcagctacaaaaggggaaggtctagatatggctatggaatggcttgccaatgctttgaagaaccgtaaataacacaatattattattttttctagtcctgtaacgtgctccagcgtgattttgtcaaatcacgtttcaaacatcagagagtcgatctttgatttaatgtatgtaaatttagaaagttattcattttagatggaatattttatttttgtaaatgtagtcgggtaatttcatttgaaggttgctgctagtttccaatttttttttaaatgcattaattaacatttgcttggtgagctgaaaaattgctcaatccaccatatgaattgaccttggatgtgaatgttggtaccattggaattcatttgacagtgttgccaacattggcacagttcaaaatctgttgatgaaaatattcataccaatatacatggtgttcattatttatgtaacaaatatttacataagacagtaatatttcaatgaatacagatattctgagcagcagctgtttctcatcacttttgtttatgctccatatggaaatctggtccgtctacaagaaccttcacctgactatacatattctttagatgtcattccaatgcctacttcatatttagtattatttcgtgaataatcaatttggaatcataaattgatgctataatgaattttgtacatttcgatagaatatagatgtcaaatataacttaatttaaa

SEQ ID NO: 690 - DNA, 2237 bp, Leptinotarsa decemlineata
  Annotation=Heat shock protein; Tribolium gene name from OrthoDB database=TC011024; Blast E-value Tribolium Gene vs. Leptinotarsa Unigene=0
aagagagactagaaaagacaaaaaggttaagtaaataagtagttttttaattgacttaccgaaatactgaataatgtcctctcttgtaagaataaatcgtttatttcctctcagacatttaataccacatgcaacaaagaatcctatcaggaatattagcaaaataaataatatcgaaggtctatcttggggaaatcgaacgttcttgagatttcttagcacggaaacgtctccaagagaagaagattatcattctataataaaggatacagaaaaacccataggagaaagtaccaaacatgaatttcaagcagagactagaatgcttttagatatagtagcaagatctttgtattctgaaaaagaagtttttatcagagaattaatatccaatgcaagtgacgcattagagaaattcagatatctttctatatcaaaagaaggtgctgagaaaataaaggatgtcgatagagcacttgaaatccatatttcaacagacaaacataatcgaaccttgaccatacaggatactgggattggtatgacagaatctgagctcatttcaaaccttggagttattgccaaatcgggatcgaaggcattcattgaagaaatgaaatcaaaacaaacaaatggtgacaacaacataataggccagtttggagtaggcttttatagtgtttttatggtcgcagataaagttgaagtttattccagagcagcaggagaagatcagggtttcaaatggacatcggatggaactggtacttatgaaattcaaccagcagaaggtgttttatttggtacaaaaatagttatacacttaaaaacggactgtcgagagtttgctgatgatgacacaatcaagagtatcataaataaatacagtaattttgttggaagccctctatatctgaatgggaaaaaagctaacattgttcaacccttatggttatcagatcccaaaagcataacaccacaacaacacaacgatttttatagattcgtcagtaagagttacgatatgccaaggtttactttacattataagactgatgtacctttgtcgattagagctttgttatattttcctgaaggaaaaccaggactgtttgaaatgtcccaggaaaaccaatcaggtgttgcactttatacaaaaaaaattctgataaaaaatagagctgataatattttaccaaagtggttgcgattcgttaaaggagttattgattctgaagacattccattgaatttaagtcgagaactgttgcagaacagtgctctcataaagaagttacgtgatgttttaactgcaaaaataattaaatttctgcaagaccaattgaagaaaaatcaagcagaatacgaaaagttttaccaggactatggaattttcattaaggaaggaatcatcacaaactatgatcaagccgaaaaggaagaagctgctcatctattaatgttcgaatcatctcaacaagaacctaataagaaagtaaatcttaatgaatatatatccagagccgctgataataggaccatattctttttagcagctcctagtcgcactctggcagaatcatctccatattatgaatctctcaaaactaaaaatcaggaagtgctcttctgttatgagccatacgacgagttagttttaacacagttgaggcagttcaaaggttataagttggtgtccgttgaaagtgatatgagagatgacaagacggctaatgatcttacgaatttgggggaagatagtttgaaacgcagtgaaatcgatgagctgtcgaattgggtgaaagataaattaagtggcaaggcggattctgttcatgctactacgcgcttagaaaatcatccatgtgtagtgacagttgaagaaatggcagcagcaagacatttcatcaaaacacagagtcataatttacctgaagacagaagatactccattttgagaccacaatttgagatcaaccccaggcatcccatcattaaaaaactacacaaattgacaaaatcggatccagaattggcagaactcttagcaaaacaattatttgcaaattctatggtaggagcaggacttgtggaagattccagatttcttctcacttctatgaacgaattgctggttaaagtgctggataagcactgacaagtggacttgccaaactacatttaattggttgttaattttgtacgttgtttcaataaagtaacttgaatgattaaac

SEQ ID NO: 691 - DNA, 2591 bp, Leptinotarsa decemlineata
  Annotation=CG8315; Tribolium gene name from OrthoDB database= TC009150; Blast E-value Tribolium Gene vs. Leptinotarsa Unigene= 1E-1; Blast E-value Tribolium Gene vs. Leptinotarsa Unigene=04
atgtcctgcatactgtatgatataaaccatgcgagaatttccataagtattctgtcatatcagagaacgaaaggacaaggttacaataatttcaagattccaaccaagataaaaatttaaaatttcaactgatatgagttgtcatcaatttattatatgaaatcatggacaaaataataaaaatcaataatcaaactgctggaagagacaaaatcgcaaggctcttacagtacatcagtcgatttttatggcacagacttcaacaaagtaataaagatggtgttgctggactaaagaatctagagtttcaactcagcactttcagaaaactacttcgatttggaagattcgctgagggattgtatacagctctaccattatttcaacaagaggatatacccacgagatacacaattattttgagcaaaatagctaattctctatttttactcgctgaccactttttatggcttggtagggctgatatatgtgcggtcgacacagaaaagtggagccgtatctcaaataaatactggttatactcaattacaatgaatttaatgagggatttttatgaaatttccctaattgtgaaatctgaaaaaagtaatattataccaaaaaatggtttaagaaattttgctgatattatgaaagctctctcgaagctatctctagctgtacaaatgaatcaaaatgtagttatagatactgtcaagaatggctgtgactttttcattccgttaacggctctgggtcatgttaagttgtctccaggtactgttggtttcttgggcgctatttcttccatcgcaggcctactagttcttctagaaccttcaaagaaattgacaccttgaaaaaaatttctattttcaaatgagtctgaaccaaatgatttaattgataatatatgttggggttatttgttttaaacaaactggcaaagtagatttgaattataatatatatttaaggttttgatacaaattgatccaaactcaaccaaatgttgaacttataaaaatcaaatttttattcacgttatgcttcttttgaggtatttgtattttgagattatttatagttccattccggtaccaaaaatgttccaaaatataagagggtattagacttgattcattataacattagaatatgccttttatggttttccaccttccgtttggtacaaaaagtgtaatctttcagatcatcaaatacggatgaaaataaagagtatctgaaacaactactcgccctattgatactgtagttagaagtaatttttttatctatttgtttaccaaaccttcataatgaaaaatgaaatgatactcatggatatctttgatactgtagttagaagtaattttttgtatctatttctttaccaatccttcataatgaaaagtgtaatggatatcattcatggggcatgttaccaccttttcctttaatgacccagtattaacattttgaaattgagtattcagaatgatgaaaagccattattctgttgattggagactgttctttcattttggttttgtaagctgagttcatgaaagttggactgtttctcaaaggttaccaaggacaagaaatatttctacgttggtactcattaaaaattaagagcttgcttgcacaagtttcaactattgaagattgttgttcttatgggaatgataatagatagatgaatcaaagtttaagaaatcaagaaacatcgagaaattactttgaattatttcaattctgtattcataaatttttgctaaacagcaatatggccaaaaggggctaagtctcgcataagcaatcaacataaatcattatcttacattatggtattagggtggaattaactttgttgtacctataccatgaacttcatatcagaaattctatttttcagactcaaaccgtttctactattaggaaaagcacagtttttcgtttaaaagtcatttgcaaaaaatatgggtcaactccttttgtccaatcaataaaaaaattttattttgtgggcattacacaacttccgtatgtcatggtcttgtaaatattggcaaggtatattttgacagcattggtaaacaaaaactttcatgtgttcttaaggcatatgggtacagttgcttttggctactatagattcactgttgtttcagatgtactctttcttctgtttgtatgtggacgaaaatctgtggatattctagatacctattttgaagtgttcaattatatttttttatcatcatttgataaattttggtatatttttaagatatccacaatacagactatcactttttatttttcatactttagattctctagttcaaataacaaagtagtttaataacaaaaattttactagcttgaaaaattgacagtttgtctgtattttttgttttgttcatggtctgttgaaagtcaagtatcctgaatttatttttataaggtcagaattaggaactgaacatatatttgcggtgatgagagccagttatttgtattattttatatatttttgttgagaaaataaaaaagaaaattttcataatttttcagaaattagg

SEQ ID NO: 692 - DNA, 9906 bp, Leptinotarsa decemlineata
  Annotation=Kinesin-like protein KIF13A; Tribolium gene name from OrthoDB database=TC008919; Blast E-value Tribolium Gene vs. Leptinotarsa Unigene=5E-132
gagtccatacaaaacgagtattacagcgcaatgtccaatattgcgttctcgaatatggcgaaagttgtgaatttacgtgttgtgataagtgctaccttgtgacttactatgtttgaaaatggatagtaaagttaatatttatacaaagaaagtgtgataatagtgtaaatatacgtatttgttgttaattaagtgagaaaaacaaaaatgtctacagataaaataaaagttgctgttcgactccgtccttttaacagaagagaacgtgatttggggacgcagtgtgttgtcgaaatcgaaaatcaacaaacaattgtacaccaaccgacaactttggataaattggaaaggaaacaacctaaaacatttgcattcgaccattgtttttgctccgtggacccaaatagaaaggacttcgcttctcaagacgtcgtctttgactgtttgggacgtgatatcctcgataatgcatttcaaggatataatgcttgtatttttgcatacggacagaccggatctggaaaatcatacacgatgatgggttcacaggacgacaagggcatcataccgagactatgcgactcattatttggtcttatagcaaaacgacaaagttcagaattaacatataaagttgaagtcagttatatggaaatctacaatgagaaggtgcacgatttactggatccccaaacaaataagcaatcactaaaagtaagggaacacaatgttctaggtccgtacgtcgatggactttcacagctggctgtgacatcgtttcaggatatcgataatttgatggcagagggtaacaaatcaaggacagttgctgcgacaaatatgaacagtgaatcatctagatctcatgcagtattcactgttatactaacccaaactttaatagattcaaaaaatggggttagtggagaaaaagtcagcagaatgtcgcttgtcgatctagcgggttctgagagggctgtgaaaacaggagcagttggggaaaggcttaaagaaggttccaatattaataagtctctaacgacattaggtctagtcatatcgaaattagcagatcaatcatcaggtagcaaaaacaaagacaagttcgtgccataccgagattctgtattaacttggttgctaaaggataatctgggaggaaatagtaaaacagtaatggttgcaacaatatcaccagcagctgacaattttgaagaaaccctgtccaccctaagatatgctgacagagcaaagagaatagtcaatcacgcagttgttaatgaagatcctaatgccagaatcattcgagaattgactcaggaggtggaggccctgaaggaaatgctgaaacatgcaacgggttcgcctgtaggtgacattcagagagtcgatattcatcaaaaattgagcgagagcgagaaattatacaaggaagtttcccagacgtgggaggagaaacttatgaaaaccgaacgaatacaaaatgaaaggcagcaagcattagaaaaaatgggaattagtatacaagattctggtataaaagtcgagaaaaataaatattacctagttaatttgaatgcagacccttacttaaatgaattattagtttattatttgaaagatgttactgtagttggtgctagtagtaataattctggcgtggaaccagatattcaattgtcggggttaggaattcaaccggagcactgcataattaccatagaagacaatggactgtttcttgaaccccttgccaatgccagatcttgcgtgaatggttctcaagttagccagaaaactccacttcgtcacggcgataggatagtctggggtaaccatcactatttcagagtaaactgcccaagatcgatatcagccacatcagaacctcatacaccagcacaaaatattgattataattttgcacgagatgaacttatgacaaatgagatgagcaacgatcctattcaaacggcaatagcgcgactcgaaaaacagcatgaagaagacaagcaagttgctttggaaaaacaacgcatagaatacgaaaggcagttccaacagctacgtaacatggtgtcaccctcaaccccctactcacaacattcatacgaccccctcagagtaggtttgagcaaaactgcaccttgtacccctacaacccaattgaaagttgatggatgggcccctgaaagtgatgagatgttccgaagaagtatagtaaaattgaaggaagatatcctaagagcgaactccttggtaaaagaagctagtttcctcgcagaagaaatggggaggcagactaaatttagtgtcactttacaaattcccccagcaaacttgagtcctaatagaaaaaaaggagcttttgtaagcgaacctgcaattttagttaaacgtaataactctagtcaagtatggtcaatggaaaaattagaaaataaaataatagacatgagagagttttacgaagatcagaaaagtaagtctgaccaggactctccaggagaactacgaggatctgatccattttttgagtcccaggaaaaccacaacctcataggagtcgctaatatttttttagaaagtcttttccatgatgtcaccttagattaccatactccaattatcagtcaacagggtgaagttgcaggtcgattgcaagttgagctcagtagagtttctggaacttttcctcaagatcgcgacaatgaatcggcttcagataattcatcagaaatcagtaatgatgaagaagaacaaagcatctcccaagttaccatacgtgttcacataaagcaagcttcaggtttgcctctgtccctcgcaaactttgtattctgtcagtatcatttttgggggcatccggaaccaatagtcgttccagacattaaccctcattcgaacaagcaacccacaactgtgaaatttgaccactccctagatttcacagtgaatgtttctgaggaatttttagaacattgtgctgaaggtgcactttcaatagaagtatggggcaacagaagtgcagggttttcaaaatataccccagggtgggaagtagttgaacaacaacttgcaacagcaagatcgttgctagatcggtggtctgagttgaccagaaaaattgaattatgggtggaaattcaagaactcaatgaacaaggggaatatgcggctgttgaagttgctatgagaacagacatgttaacaggtggcatctaccaattacggcaaggccaacaacgaagaatccaagttagagttaaaccagttcaaaattcaggaacattgcctatcatttgtcagcagataattaaaattgaagtagggggagtaatggtcagaagtagattacagaaagcactagattcataccaagaggaagatttgaccgttttaagggaaaaatggaatgatgctcttcagaaacgaaggcaatatttgaaccaacagcttcagaatttattggaaaagagcgataaaactgaacaagatatagaaagagaaaagagtttgatggagcaattggtcaacttgactgaagaaagcaatgcagtttgtataccccaaccaggtagtggaataccaggtgctccggcaatgtggagtccgccccctggaatggaaccacatgtacctgtactctttttaaacctaaatgctgatgacttatccacacatcctaccgttgctggcgtcaattccattcttcccaaagaggatggacggcaattttatagtcttcacatcctcaatcatttagacaaagatgtatgtgctatagcaagttgggattcgtccattcatgacagtccaaacttgaataaagtcacagaaaccaatgaaagagtttatatgattttaagagtgaccgtaagattatcacacctagctcctatggaacttgttctgcgaaaacgcttagctctaaatgtatataaacgacaaagcataacagacagaataaaaaatcaaataaaatcaaaaatagctcgcagtgatctagtaacgtcttgtggtgttacatatttagttgtttcaaatgttcctaaagctagtgaggaattagaaggtagagagagtctggcacaattggcagcttcgggagaaaattcttctttttgtgatggagaaacatatatagagaaatatacaaggggtgttagcgcagtggaaagtattctagccttagacaagttacgacaaagtgttgctgttaaagaattacttcaagcaagaggtcaaccgctcattatgagaaagacagtcagtgttcccaatttttcacagcttatgaaactcgatctaagcacagaatctctttgcatgtcaagatcagaaagcgtatcagagttgaacactgaatcaaacctaacacccctgagaaatcgatcatcctttggaaaagatccagaaataacttcgccaaaattcggaggactggtattttctggtatgccatcaccagccaatacaaaactcggtttgagaatgacaacattgcatgaagaacctacgaaagcactaccacgcaaacattcctttgatttattgatggatgacactattgaagaacaaactgaagaaggaactaatggaaaaacagaagttcattatatacagaaaaataagagtcatgccaagaagtccctcccgatgtcacgtacgttggattcattaacagagtttgcaccaaaacctaatactccctcatcaagttctagtggttatggatcacaggcagtttcaattacaaacctttcaagtgatgattcaatttccttgaaaagtttgaatgaaactcccgatgtggagtgcaaagcaaacaacgatttacagacggtgtcagaagtagctgatgtgaatgcagaattggacagactctctgttcaggaagacagagctgaagggtctacaaataacgaagagagctcagatgatttgattaatggtgtggatagcgattcaaatcaaaatcaaactggaagtgaccttacagaatcaagttctttaataaaaaccaatttatctcctggaagagttgtacgcaggaaaaaacaaaccagaaatcaacaggctcacagagcttcatttccacaggctcgtttacatatgtccgaaagcaaatctgctcataacttattaagtaaaaatagtttgacattatctacagaagatgagagtttgtatagctctacagatagattagaagatgaccaggaaaatagttttggttctcgtcctgatctttcaaaaattcatgatgttcccgtccctgattgggtggtattaggtgaaagtgtgctaatcaggccctacaattcatcgggagttgtggcttatattggaggcaccgagtttgccagtgggacatggattggagtagcattggatgctcctaaaggaaaaaacgatggcagcataaagggtataagatatttcgactgtaagccaaaacatggtatgtttgtgagggctgataaactaatattggatagaagaggccgagcaatgagacttgataaggctgaagctcttgccaatagcaataaatgttctttgagcaaagatacattgccaagatctcgatcacgaggaaatggtttgaacacagtagggactcggccgagttcgaaagccaagtagaatgagaaaaataaagcatcgaccacctttccattagtcgtccaccctatttattgccatttgccgtgttttacgacacaaatctgtgtgccgtccatctacatggcgtagtgttattcatccttgccatttcatatataaatattgtcacgatgtaatattgtttggttgcacttgaaaaaaagcgagcactagcttggtatatactgtcatagttttcttacaacttccacacacaaatgccttcatgttatcaaagttacatcgagaatcaaaatattttttggacaagatgatataattttttacctactctctcgttgtaacctttcaaaaccatgagaaaatatacaaccattattttggaattatgttgcacaagcatagaaaccacttgagttttcaaccagatactacctcctttgagttggtcaagagtccttagttagattttcattgtttttaagtcaattttgagctttcagaactatacagatgggtgctggtaggaggttgtggtaggtttttcaaaacatgaatatctctagtggtctctattttcgggaaacagtacaaaatatcagtgctgttgttggccatgtgtgccaccacataaattgaatccatcagtatattattcttcatacactaatttaaatattcatttttccataacatctttgttcccctaccacataacatttaacgattttcaaaccattcgcaaatgttacttaacgaattatgccccagtcaatttctaatctatttgccttcaggcaagtgatcatcatagagtgtctgtttcaaaagttcttcacattatttgaaaaaaataatggagaaagaatgaggaagggacaaagttgtgcactgattatgtgttgtctggttcccattatcgaaacactattcaccgttttagtttaagcatttctttctgtgatatagttagtgtacacagatcactttggttctaatttatgtgaattttatacatattttttgcgtgctgtataactgaacagaattaaaatagagatatgtaactgtaatagacaaaaaatatgtagcttacaagtatttaactaattctgtgtgtctttagagagaaaaaatttagtattaaggataacatcatagatacaataatagtatttcaataattttccgatttctaatttagattgagaactgccacaggtacggccaaaaaactcagctgcaatcttagttcacaatatttataacagtttaatgtgagtgaattttattttcaattaattccaatattttcaatatcttcattatggaaacacattagaaataaaaataaaaaccgattattgatcctacatatttcataagtccaataaaaaatataaaatcttcatatctcaatcatttctattgaatatgttgtcaaaggattgaaacttaattattataaagtttttcacctacatatctcagaaataattttgtaatatatcaagcctagatctgctttgatacattttaaacataattcactttactcaacttaaatattatcaaatcatcaggtccaaacaagttttagtaagcagctgttcattattgtagtttttactcaatttattccatctgaagaactgaatatcataattataatagtatagaaatatgttcttcgaaggagatattttctaaggatccaaaaaaatcatatgagaccaattaattgtgaagaaatcatggtaaaaactttctcactaattttaggaaaacatttagtaatagggttaaatagttctttgaacaagctggttaacaaaataaaaaaaaattgtctaggttacctatgatttacagttttgaacgaaaatcttattctctacatatacacattatcaattcaagttgatttttttctagtattgcaggtgagtttggctgcatcttctcagttttgcattttgtcattaacacattccatgaaaatcaatgtaaatgtaatgaatgcaatatgatctagtctctatggtttatttattgctcagatttagaggtttagtcgtccactgactgtaactgaagtattaatgatgatgaaaaaatacaaacaacagaaattgtcaattcgacctaagattcgagttaaaaacttcaggactcgtccagaattttagaaaaaactcaatgtatcattatttcaacttcagttgatcattttccagtcaacagaataaatactagaccttttcctgtccaatttaaattattctgtccagtttgttataaattttaataaaatgtattatatcagcctgatgttacatttagttatcaaattgattgattgtaggaaataaaccataataattattgcatgtcaaatacaatcaaatttcatgataaaaaaacgtatcttactatgattttaagaaccattttagaaacattcgaaaccttatatctacaaattgctggaaatgaaaaccaggatttccagtgaaagttagtgaaaaaatttatattaagtacaacattcgtaaatactctgaaggtgtgcaaaatttcattcaatacacaagatgtctactaactttaatcaactgatgttcggatgtatattttcagaatacatatatttcaaaacatttcgactgtaaaatagttccctttcgtaggtaatgttcatctatttcagttaagtagtattttgaaacagatatataattttgcaataaggtaaatattctgaaatcttgtaaaagtaaccgatgtaaacttgacgggaccaaaaaatctcaactcctgaattcatcatcaagcatcattttatatatgtgcaatttctgtcaaaatttcttcgacaatattgagttgtgtaattcaactaagttaccttgattcaattaactcaatactacattgtgcaataacgaatataaattattgtcatggccactgaactgaaaccattaccttcaataatctgaagcagtgaaaatgaaacatcaaggcaccacaaccacatctagatgatgacaggaggctgagtgttttggtcactgtgttcacctgtacattcaataatgtaaataaaatgtttttcaatatttctcatcaagagtaataaaagcctttggttttcattcgatctggaattgttgttttttatgtaattagactcaaatagttataaaatattttatatatattgtgtacatttttgttgtttacattaaattattttaccttgacattttaatagtttttagagtttatttgtagctgtggtcctacaagcaattacaatatatgaacattaaataagtgtttttcatgaaagaaatctaaacccaagaattaggggccaatcaacatgagcaatggcatcgagacttcttagaactttcaagaacatatattccaaaagaaatgcagatcccatcagaagagccttatatctcgtttcccgaatattgctaggcatttgtaataaaatgttgtaagacacttgaacttggtcccactgatatatgatgcttcctatctgagttgaaccatcaaagttatatatctgaaaattttctgctttccctagtaaacacccgaatgaacttggtccttctattcgatacaataactcgttatgtctgttataaacatgaaaattaggtttcatgttgaaggacatattttgtgaaatggttcctagaagttctccagggggtatccaaatctccattttctgaagatagcaccagaatgtacaagttccacatgctagccttcgtttcaaaagaagggtttcctgttgagttttgtcatatagcctcatactgaaatctctaccagatccaaaacacatcctctgacaaccatctgaactttctgttgcataatatattgtatctcctctaggatttcttatggtatatctattctcagaagacacagatgatactagatcagccaattctatactttgttgaattatcagttgattgacatcatgcaaaaaatcgagtccagacaaaggagcaaacgttcggttcaaattttgatcgatcaaagagacgggtatgggtctcctgggcccaggaaatccggcactagttggttggttagttactggttcagtgaaggttgaaaattcttccatattgctatacaaattaatttcatgttgcattttactacactatttgacagacaaattatatgaaacgatatttagctacactttacagtcactccccgaaaaaa

SEQ ID NO: 693 - DNA, 3719 bp, Leptinotarsa decemlineata
  Annotation=Probable cation-transporting ATPase 13A1; Tribolium gene name from OrthoDB database=TC014807; Blast E-value Tribolium Gene vs. Leptinotarsa Unigene=0
gattgaacaagtacgtcaaaaatcaaatcacatatgtgttcaccaacgggttaaattaaaaaaaaccttattaataatgactgtaacaccaaaattagatgacttggtacaatctgtttctctacattctcgtttcccagctttatttcatttttatgttttaccattcatagtaatttatttggcatggttctacttgtggttaggagtttatggatttttggaatactatgagggtggttttcttggagttggtattataggaatatgccaaattttgtgtagtttagcttgttactggtccgttcatataaattgtttgttttcatgcaggaaagaaaaagatcctgacaaagctactcttgtgaaagttatacccacacctaataatggaagttctgaacttgttcccttacagcatactaagaatgaaaagattactacgttttggttcattttccaaaagacaaagtatatttggtgtaatgaaaaaaaatcatttcgtggattggaattccccattaataatagtttttccgaatacatggcatgcaagggttttcaagaggaagcagacattctagcagctgagcaactttatggaaaaaacaatgtggaaatggttgttcccgagtttatggaactcttcattgatcgagcaactgcaccattttttgttttccaagttttttgtgttgccctgtggtgtcttgatgacttttggtattattcattattcactttggtgatgctagttctgtttgaatgtactctggtccagcaacaattacgcaatatggctgaaatccgcaaaatgggtaacaaaccgtatggtattctggtgtaccgtaataggaaatggagaacaatctctacctgtgaattaataccaggagatatcatttctataactcgatcacatagggatagtctgataccttgtgatgtgcttttgctcagaggttcctgtattgttgatgagagtatgctgacaggagagagtgttccacaaatgaaggaggctgtggaaatatttgatcagaaaaccattttagatccagaaggcgatggaaagttgcatgttctatttggtggtacaaaagtggttcagcacactcctccaagtaaagcaacaactagcttgagacctcaagacaatggatgcttagcttacgttctacgtacaggcttcaatacttctcagggaaaacttttaagaacaattctgtttggtgttaagcgtgtcacagcaaataacaaagaaacatttggtttcataatgttcttattgatttttgctattgcagctgcttggtatgtttggcaaaaagggattgaagatccagaaaggaatcgatataagttgtttttagagtgtacactgatattaacatctgttataccaccagagttgcctattgagctatcattggctgtaaatacatctttgatagctctatctaaattaggtgttttctgtaccgaaccatttcgaatacctttcgcaggcaaagtagacatttgttgttttgacaagactggaactcttacaagtgatgatttaattgtagaaggagtggctttggctgaaaaagattccacagtcactgcagtatatgatctacctttagaaacggtacaagtactagccacttgtcattcccttgtccatcttgacgagggtttggttggtgatcctctggaaaaagcgactctaaatgctattgaatggaatgttacaaaagcagatgctgttgttcctaagaaggggaaatcccctggaatgaaaatttttcacaggttccatttttcttcagccctaaaaaggatgtctgttatagctgggtacaatagtattggctcaaccgagactatgtatgtttctactgttaagggtgctccagaaatactaaagtctatgtttatagaaacaccaaaaaaatatgatgaagtttacttggatttgtctaggcgaggggccagagttttggcgttaggttacagggatattggaaaactctccagccaagagcttcgagatttgactagagaagatgtagaaaaagatctcaagtttgttggatttatgatcatatcttgcccgctcaaagttgactctaaatcagtcattgaagaacttcaatactcctcacacaaagctgttatgataacaggagacaatcctctgactgcttgccacgtagccaaagaactcagattcactccaaaacctactttgatattgacccaaactaatgaaatttttgaatggcaaagcattgatgaaactcagaatctacctcttgaatacgattataaaaatctagtcagacagtatgatctctgtattacaggagatggtctgaactatcttagaaataactacaatgcattcctgaatctcattctaccgcacataacaatatttgcaaggttcgcacccaaacagaaagaattcgtaattgtcaagttgaaaagcttgggttacacgacattgatgtgtggtgatggtacaaacgatgtaggagctctcaagcatgctgacgttggtgttgccatattggctaatgctccggaacgtctaccagatccaaaagaactgagggagaggttagagaaagaaaaggaaaggaagcaaagagagcttaaggaagctatgcagaggactaggccgaatcatgtaagaaatatgatggatcaaagagaacgaatacaatctaaaatggacaaaattatgagagagcttgaagaacaggatgaactccaagttgtgaaactcggagatgcgagcattgcttctccatttacaagcaagttgtcatctatcatgtgcatttgccatataataaaacaaggaagatgtacactggtcaccacattgcaaatgttcaaaattttggccctgaatgctctgatattagcttacactcagtctgttctatatttggatggaatcaaacttagagaccttcaagcaacattacagggtctattattggctgcttgtttcttgttcatttcaagatctaagcctttgaaagtcttgtcgaaacagcgacctctaccgaatatattcaacttttatacagtgttgactgtaattctgcaattcaccgtacattttatgtgtctaatttttcttgtccaacaagccaaagcaaggactccaagcgaagaaaaatcagctaatgtaaccaatcctgttgaagcattgacagaggaagaaaaagacaaattatttgaaccaaacatcataaacagtactgtgtatatcatttcaatggcattacaaattgccacttttgctataaattataggggtaatccctatatggaaagccttaggcagaacaaagctttactatacagtattttgggttcgggaggagttgtacttgctctcaccttgggaattgttcctgaattgtcagctcagtttgaaattatagattttccaccagattttcggatcatccttgtgcaagttctttttgctgatttcttcttttctttcttggtggacaggatatgtctatggatatgtggcgaaggcagcatgaggctatcatgagagtattacaaatgaagttatttatttattgtcattccagttaaatgaaacatgaagggataaacctttatagataatgtcttattaaatgcatttgtgagtaaagatactttttaataaaactaaaaaaaaaaaaaaaaaaaaagta

SEQ ID NO: 694 - DNA, 1612 bp, Leptinotarsa decemlineata
  Annotation=Casein kinase II subunit beta; Tribolium gene name from OrthoDB database=TC000224; Blast E-value Tribolium Gene vs. Leptinotarsa Unigene=3E-71
atctgtcgtgcagatgactactgactagagagtcgatttccttttcgtgtagatgaagttaacgtaagcgtggctaatcaaggtacaaaaagaaaaatgagcagctcagaggaggtatcatggatttcgtggttctgcggtctgagaggaaacgagtttttttgcgaggtggacgaagattatatccaagacaaattcaatttgacggggttaaatgaacaagtgccgcactataggcaagctctggatatgattttagacttagaaccagatgatgaattagatgataaccctaaccaatcagatctgatagaacaagcagctgaaatgctgtacggactaattcatgctaggtatattttaacaaatcgtggaattgcgcagatgatagagaaataccagtcaggagactttggatactgcccgagggtatattgcgaatcacagcccatgttaccattaggcttatctgatgttcccggagaagcgatggtgaaatcttactgtccgaaatgtatggacgtgtacacaccaaaatcgtcgagacatcaccacacagacggagcctatttcggcaccggtttcccacacatgttgtttatggtgcatccagaatataggcctaaacgtcccacaaatcaattcgtacctaggttattcggtttcaaaatacaccccttggcatatcagttgcagcaacaggcggcatctacattcaagacccctctcagaagtttgaatttcaacaacggcaagcgctaaaagtggacctatctgatgaattgtaatcaaactgaaaaaataccatagttaaaacgtgttacgaaggaattgtattactttttatcagttgagtgacctgtagttatatattattttatatatgaaattgaaacagttgaggagttttcagtctgctgattttgttctggggtcatttcaaacaagtggggtggaagttggaatcgcaaaagtcgtcaaactaataccaaaagaaaatatgagtttttcattaaatatccttcatttcatcaaatgaatatataatataaaatgtttcttgaagatgagtaaaggatttacattcctcagtttgtaagcattatttttgttttataagaatctgattcattccagaataaagaaggcattttgaattatttctgagaagcagactttcaatgattagaagaaccagaatattctaactttttattctttagtgaatcagcatctaaaaacaatttttcagtaattcatggttttttatttgacttttgtgagacgatttcagtgagattttcaatataaatagtatgtcattcattttcctaattcactgtttgtaaaagctaatcaaatactaggttattatttatgttatgtacaaccctgtttataaatacagagtgctgtgtgtgttggccaaaattgattctgaaatatctttttttttgtgaaatctcgtttttcgtttttacttgtatatatttccatgaattttggcaaacagtggatacctctgtattgctaaggttttaatattattaaattagtaattataagaaaaaaaaaaaaaaaaaagtactactagcgttagaataccaactgc

SEQ ID NO: 695 - DNA, 4868 bp, Leptinotarsa decemlineata
  Annotation=Striatin; Tribolium gene name from OrthoDB database= TC007565; Blast E-value Tribolium Gene vs. Leptinotarsa Unigene= 0
gatgttactctggttctgacagaaacaaagaagaaaattttaccagatgttgaggttggttgggagttgatgcgtgagatattttttcgtgtttttgtatgaaatatcaaaattaaaacatagtttattaaataacataaaatataagtttgtgaataattgtgtgtttgttataatattatcgaactgtaataagtgattggttcgattcgaattaaaatggcgatttgaagagcaatggtggacatatgaaatttcctacttttgaaaccgactacacaatggaagacaactccctcaaccttcaaaatggtggtcagatgggtcctcagagcggctccgttggaaataataaacaaagcgatgaagtgaatccgaaatcccattattccataccgggaatattacattttatccaacatgaatgggctaggttcgaattggagagatcgcaatgggaagtcgatagagcagagttacaagctcgaattgcctttctacagggcgagagaaagggacaggaaaacctcaagaatgaccttgtacgacgtataaagatgttggaatacgccctcaagcaggaaagggcgaaattccacaaattgaagtacggcacggagctgcagcaaggcgatatgaaaccacctgtgatagatgaaacaggcgaatcccaattggaatcggatcagtcctatgtctccgtaacgaattccacatggaagcaaggtcgtcaattgctgcggcaatatttgcaagaaatcggctataccgatagaataatcgatgttaggtcaacaagagttagagctctactcggtctgaataacaataatgccgatcaggaggagaaccataatagtagttcggtgaatggtaatgaatccaataaaagggctagtgaaactcaaggcaggagaactccagcaaaaaaggcacaaccaggctctctagcagaagcaatgatgttggatactgaagcagcagtaatggcgaatctagacttcctatccaatactgacgtcgatatggacgacgatgaagatatgagcgatgatgtggatatcgaacccacagaagatatcgaagacgatgtcaaacttggtaaaaaagttttaggcgatgacgtggatgccattgctttagaagttttcaatgaactaaatcagttgtcggagacggaaaagaaacaagacatcaaaggcgaacaagctgattggaataaggcaccaatcccgaagcgacccataggaatgaatgatgaagaaaatttcgactcgagtctcggacttggcgagttagctcaattaacagttaataatgatgctgaaaatacgtacgatattgctagcagtaaggaggcatttaggaaaacatggaacgccaaatatacgctccgcagtcatttcgacggtgtgcgtgctctagctttccatccagtcgatcccgttttgataacggcaagcgaggatcacactttgaaattatggaatctacagaagactgttcctgctaagaaaagtgcgtcgttggatgttgagcctctctatacgtttagatgtcatacaggaccagtactgtgtcttgctgtatcaggaacaggagaacattgctattcaggtggactagatggtgctgtgaattgttggaatgttcccaattccaacattgatccatacgatctgtatgagcccgatatcctgaatgctgctcttcacgggcattcagatgccgtctggggattggcggtcttgaattccaaacagcaacttttgtcctgttctgctgacggaactgtcaagctatggactccacacagtaagcaacaactcttgtcaacgtacgtttcggaacaagacggtattccttccagtgttgactttgtgagagacgaaccaaaccgtatagtagcttcatactctagttcgcattgcgttatattcgatacagaaaccggaaaggctgtgactaggttagagtctacggctccagacggagtgaactctagcgctaggcaaatcaataagattgtatgtcatccaacattagctgtgacaatcacagctcacgaagataggcacatcagattctgggacaatcacacgggaaaaatggtacattctatggtggcgcatctggatgccgtcactagtttggctgttgatcctaacggattgtatcttctctcaggatcacatgattgttcgattaggttgtggcatttagacaacaagacttgtgttcaagaaatcaccgcacatcgtaaaaagtttgacgagagcatcttagatgtggctttccatccatcaagaccgtatatagcaagtgctggggccgacggtctagctaaagtttttgtgtaaaactttttaagttgaattcacgaaccttctgataactacgaaccattttgaaagtgattcatttattatctcatttgcttttataattattacatttagcaggttaggtgtacatatattatagaattttaatattttgtatatataatcccaaaatcactttaatcttaattttaattgattgatattcttttgtaaataagtttatttatttcgtcacttggtttacggatttttttgtgttgtacaatcaacttgcttgctgtttggtccatttcaaaacccgagtatcgcctataaaaaatgtatatggaatattgttttcgaaatattgtttactccaaggattacttttgagttatttgagtgaatcacacatgtgatttttcattattttttactgcggcgtttcccgactaacaaattttaaaaaatcgttgaagatattcaagatattttaacctttttttgtgttattggatttcgaacatgtttttggacaatattaacaatgtcagtactttgcagtaatatatgttttgttattgtgcttttccgaaatagttggctttggagaaatgcatatataacatcaatatggattattttggctttgtactccgcttggttttcgataattctaggcttgataattattgaaaatcgagttgtacagaaatgattttagttaattaaattaattaatcctgaatagtttaggtgagcccttcacatattttgcaatttttctctaaaactgactgttcagatttcaagtgtatcctacgtcaagtattgatatttttttaatagtcaaatataatcaatattttaggcattatttgagtcttcatcagtgcttaattttcgaatcagggttgtgtaatatgaatgaattcatcttgaacaatttagacattttgagtgatcagacaattcattcttgtggggcataacctcaaaattgctactacagaatctacaaaaaaatttactggcggaaagttgtacaaagaaaaaaaattattttgagttgaaaaactccaaaacacgtgaaaaaattggtttccgacgtgtttacgttagacacaccactctgaaaaaactgattaaatttataatggtagtgattattatccatgataataattacagaatattaacaacaaattcaatttaaaacgtgtttggttacatggtaacttctttagttactagtgaagtgaatagtgttattcattttcatcaagtaacggatcagagtattcataatagagattatttcaaaatatatgaaaaaaatatcattttatccaataaactgcaccccgaaggaattttgaagcttttaaactcgattttaaggttatgtttgttcaagtttctactagtaaaacctttttgtagattctgcactgggaaaacagtttttatcgtaagtaattatctcctccattgttcttttaggggtcaacaaaaatttgtaaacaggtaaattcacaacagctagaaccgttattgactatttcatacacattatccaccattttaagaaaatttggtactgattttatctcaacacatatcttatttaacatttccatcactttcaaatagaataatttaaaagcaatcatatgttatttggtttaatttatctcgtcacaattcaaaaattataccccaaatggtttgataacagcaaatcgaactgtagagtgttaatcaagtagacacaggaagtagtaaacgggtccaaatcaacccaagattgtagcgtttccaattatttccatgagttgaacatttcccatgttctaaatctcctcgtttgacattgccactaaatatttttcgaaccaatctcttgttttcatttggacaaattatgtttgtgaagcttttacttgatcaacactaaccttgttcagattgccttcttgaatcacttgctattttgtttttcaaattgtgacatgacaacattgttgtaggaatcagaaaataatccgtttgatgaaacaaagcgttgataatatttttcgaatattagttggacggtacttgatgtggggcatgctgtatatgatctttttatattctgggttttgcaaatgagaacatgatcagcactggaacaagttatgcttaagtgaaacatgtaaataaaattacaaacatagctgcaaagggcgtcctaccaactacatttatatcactctgtcattatttattatgtacatttgtcctaccaagtaggttttaagacctttaatataagaatttgatgtataaaagctattgtttatcgaataatacttgtaattatctcaaaaaatacagcaggttactggaccgttagtcatagaataaaatagtgtactaaaataaggaaattaattcgaacaagctaacatcacgatctttcttctggattttttagattttcattaacagttgtgatggaaatcttgtcaacatgaacaaataaactgaaatctctatatg

SEQ ID NO: 696 - DNA, 6767 bp, Leptinotarsa decemlineata
  Annotation=Very low-density lipoprotein receptor; Tribolium gene name from OrthoDB database=TC012794; Blast E-value Tribolium Gene vs. Leptinotarsa Unigene=4E-33
acagtgtatattcaagacaacaacatatataaaccaaataaaagtattatcaatagaaaatacaaattagtaactacctcacttaaattacacttgatattcccagtttcgattctaaagctacaaaacatcatgttatacattacctaacattatgtcaaaaaaataaaaaatcttttatgtttggaaaatattttgtgattttgataccatttctggttcaggatagtaagcaaatgatcaaactaatcaaaaactatacctaattcataaacagatccagtgatactatttgacaaatcggtagctgaaaaaactgaatcagctcacaaccgaatttcccaatgaacaagtgggattagttaattaatcaatgttgagtcattaacaaagcacatcaaccgcaatagtatatatgaaattgttagtttgagaaatgaaaccgagagacatgagtatttgagcataaagaagtatcttgtaataactgcttatcagccagtacaaccattttatttacttataaacgactgcttggttgtggttagtttattatacttgcaaataaacaacttagctgccattataaacattatagttacctatacacaaccatcggaattaaaaaaactaaaagcttggtacatagattagtaaaaaatataatttatttaatatcagtcacgacgattacttcatatatacaaggacgtattcgtgttctatcaatagaacactcagaaatcgatacctattttgacaaaagttgccctaaggaaatggcacatttcacagcaattaatttataatattaaattagataaagctttttacatggtaacacaccaagaaagtagattgaggaaattcaaacacattggtttgagtcagtctaagataaaaattttgttactctattcataatttctttggcgccattttttcaaatccccgaaaaagttacatttattaattgaaaagtcttgaaaaacagattgaattacagtaagtttggataattttttcaataatattattgaatgtttattaattcattagaaactaatttctattaatttttccaatcattggaatgtcttgaaatattaatacatagtcaaaagtatgcgttaagacatgtttgtttatttttgcggtgaatagtgttagtatagttagtgcttcttgaatcaaatattaggttctttgtactttctcttgaaacagtcactcataaaaaccgaattatgaatacctgatttcaacaaaaattcttgaacttaacaaattaacaaacttcattgttcctccctcattctaccatcttcatgtattatcaactaacctagccgagttgaagaaatgtaaaaaaattgaactacatttcttctgaggcaggaggaggagtttcgtctgcactgtgctctagaagaacagccttctcatctttaacgctacccgtacagttgaatacatgttcatatacaggattagcgaaattaccagactgatcagcatccaatgagaaaggctccgcatctctttcttgataaattggattgctaaaatcattctcctgcagcctttcatgtgagaaaggagttctgctcttgaagcaatattcaaagacgaaaaatccgcctatcagaactattattatgactgttatggcagacagcataggaactaaaatgcttcgagattctttttccagctttcctttatttgtgaaataagcttgttcacatctgacgcctttatattcctcagtgcaagtacaataagccacttcttcactaacggaacaggtacctccattttggcaaaagtcttcgcaaactgcaggtctttcacaatatgtacctgtccaacgttttgtacagtgacacaccggctgatcttctaatgaatgcacaacacacacaccactattgagacagcgattcaggcaaggattcgagccaatgatatatttctcacaattttttccgacccactctttggggcactgacaaacagtttcattgacaattgtatttggcttgacaggaaaaccattatggcaatccatattttccacacatcctttgggaggatatctttcttggcataaattaatctcgcatcgccttccccgaaagttctcagggcagtcacactcaggttgcttggaacccattttgcatctgccgccattctggcaaagattatcacaaccgttctgttcgcatctatctccagtgtatcccagcatacatacgcaacgtaacactccattctgcaagaaaggtttaccatgtttgccacatacagaagtttcacaatgttgtcctttgaaaccagtggaacaattgcacatcatgagatcgtttgcttttgaacatactccgccattttcgcaaatgaatttctcgcaatgctgacaccttatacctgtgaaacctgataggcaagtacatcggggtattccagattttaataatgtacaggtaccattattgaagcatctaccttcacataggtcaactggtgtctcacacctcgcacctgtccatctaggtggacaattacaccttaaaggcggtttggtatctgcagatttcgcagaataaatatctacatagcacagtccatggtttttacagtactgagagcaacgataatgctcacaatgagccccgtcatattgcggtgggcacacacacttagggccttgactctgtatttggcaagtccccgtatggcaatccagagaacaacctgagttagtcggcgatgctgctttacaggtcaagttatccttaacataaccgtcggcacaggtacaagtagctcctcttggagtcaacaaacaaaactcactgtcgttacaatagtcgtaacaggtattattcatctcaatgtgtttgtgtggatgcaatattaaaatatctgatattcgagccaggcttcgtgccaaaacagtgatatttccttttccaaacttattgatacggaatatatcatgtttgtgatgcgttgagacaaacaagttttcttcaaagacttctattttgaatggtttaatgcctgtatcaaaatgcctaatcacatgcctgtcagttccatcgtacagtacacattccactgccatggtcttcggatcagcccagtacaacctgttagtaccgtgatcaacagccaaaccagttggccacagtattccactactaacaagaactctccttttatatccgtccatgtaagcagtctctattctaggggctggaccccaatcggcccagaacatcactccatgttcaggtacaacaattatgtctcttggttgttgtatgttaccagttagtagtgtgtacacataatttccgtcaatagaggatgcaagcaatctgttaccgtcagttacatagattcttcttgcagcccaatcaatactaattcctctgggatcctggagatttgataatatagttttggccacatctgcgtccctgttagatcgaccatctttgtcgatatggatgaccattgactgaactcttttgttttgatggtccgtccaaaatgctaccgcttgcctgctagaagacaagatatctacagcatcaactttataccctggagcagtagctagagtttttttcagtttgttttcattatctccggatttgtatggagatataactcgcagttcagcttctgctgcgagaaccagctctgctaggtcccctatagctcgacactgtcctgcctcagtgtgcctatatccatctaggcacttacacatagtgtgattttgtctctcttcaacacatatttgtgaacaactgttccatttacaagctgatgtcacacagtcaatttcatcactattatcttcacaatcattgaaactatcgcatcgcaaggtgttgtcaatgcagcggccgtttttgcaagcaaattgatttgaaggacatagaccatacctcttacaaatatgtttgtcttcatcacttccatctccgcactgattttttccatcacaaaggaaatttataggtacacaacgatggttcttgcacctgaatcttccagctggacaagcatttgaaaagcagttgagctcatcagaaccgtcttcgcaatcattttgaccatcacaacgccattgttcattgatgcagaaaccattatgacatttgaaaccgttatgaacacacgattcggtgcaatttgtttcatcagatccatctgggcagtctacctcaccatcacatttccaagctaaaaatatgcatattttggggtcagaacattggaattcattgtttttgcactgagtggtacagccagcttcatcagatcgatcttcacactgatattcaccatcacatttcatactgccacgaatgcactttccattggtacatcggaactcggactcggaacaatttcgtggaacgcaaccctcttcatctgatccatctccacaatcctcttcataatcacatctccatcttcctggaatacacttattgttcttgcattggaagtaagttggtgcgcaagtgtgataatctggatgactgcatgtttttggttcatcttcaccttcggcacaatcaagatccccatcacataaccaagaatgtggaatacacctcccagagttgcatcgaaaatggtggggtccgcaagttctgctgtcgcaatcttgttcctcgtcagagttatctgtgcagtcattatctttatcgcaaacccaaacgtcaggtatacacttgtggttggcacacttgaattggtttatgggacacgtcgctacgggacagttttgttcatcttcgccaaggggacagtctgtgtgattattacatctctgtttcgaaggtatgcacatcataggtactgtagcgttgccctcgcacctaaattgtgtattgagacaagtataattgccacaatcactttcatctgacttatcgccgcagtcatccttggcattgcacagatccgaaggatggatacagtgcccattcttacactggtactgaccaggcatgcaattgaactttggacaatccgctggctcatcactgccatctccgcaatcgtcctgggtgtcacacttccaccagaaaggaatgcatttgtaactcgatttacattcgaaatgggccaaagtacaattggctatacaactgcgaccatcttggcccaggaggtagttttctgggcaagcacatttataaaacggttctttaggagtcaacaggcacagaactgaacagtttgctgttgaacagggactttttttaactgctggttgtctgaatggatgaacaaccttgacatccatcggtcgatgaactaatgaaagaatggttttacagtcttggcctgtgtgtttgttgcacctctctatagtttttgtctcccaatcagtccaataaatattgtcctcccaaacatctatagaaaatacatggtgcagctgtacattaggattcttttgccgactcgttattattttgacatttttcccatccaagtctgacactgctatatagtcttcacgagcatcagcccagtatagttcgtttgtttcatacgaaatagttagcgcattaggccatccaagatttgatgtaactatcaatttagggtctgaaccgtccataccggccttaccgatatgcactctgaatccccaatcagtccagtacatatagccttttgtaggatctaatgctatagctctcggttcctccaagccctttgagtgcaacactcttcgatattttccatccaagcttgacacttcgattgtgtccagacccttatcacaccaatacaagtttctcccaatccaatcaactgctaaaccatctggattctgtagtgttggagagtgaagtatctctacctccgtcgagtttttcttataatcacagagccgttttattgaagatccaaactttgtcacgtctgaccaatatatgcactgacttaaccaatcataatccagagctactccatttgtcaaattatgagctaagagtgtactggttcctgtcaaatctacttccctaatataatacctatttgctaaaatcagattaaccttaatagtggaattagccttgcaggattttttatcgtattgtagtatgtaatctttgtgacaactacagtggtatgaacctcgagtatttctgcaaatctgactacaaggtttttgcaaacattcgtcgacatcgtcacagtgtttaggatctttggaactaactctgaagcccaatttacacatacattcgtatccgacgggtttatctacgcaaatttgagcgcaaggagatggtgtggcagaacattcatcaattccgcatttattttcgtcggaaaaatctccgcaattattctccccattgcacaacaaggtatcattgatacatacgccattatcacaatgaaaccatccttttttcttacagtattggtcctcggttttctcgcaatgtctgccttcatcgctaccatctccacagtcatctgttccatcacatttcatactctccaaaatgcaattgtcattgtcgcattggtattcgccggtggagcaggttttatagcagtcgtcaggttcgtcggatccatctatacattcgcggtctccgtcgcaataatatatttttcctatgcactgtccatctgaacagcggaactgattttcattgcaattattgaatgtgcaaccttgtaatatatgttcatcagtattatct

SEQ ID NO: 697 - DNA, 1124 bp, Leptinotarsa decemlineata
  Annotation=Splicing factor, arginine/serine-rich 2; Tribolium gene name from OrthoDB database=TC030627; Blast E-value Tribolium Gene vs. Leptinotarsa Unigene=9E-5; Blast E-value Tribolium Gene vs. Leptinotarsa Unigene=0
gcttcagtctattcaacacttacggaaacatttttattgctccttcaattacttacaagacaaaacattttttcatcaaagtgtttgcgcctgttttcaaaatcatgaattgaacatacttcaaattgaaaacaggaatggtttactcgctttgtgaaagtttgctaatgctaatcattttgatctctacagtttacatccaagtatgaatgaacacatcaaatcaaataaaaagttgcaaacataatcttgaaactacacacttgatgaattttcgaaaattcaatttttttgttcaaagtacagatcaatctaacctaaaaaacgtgagcagggacaaaactgcttcaaaaacaattgttaaaccaaaaaatcccagaattatatacaaacattattcctatctatgaaaaacgatataattttaaaacaaagatctttcaaacttttaggtctaaggtggtaggttttgaataaatacctttagaggcaggccctaatgaactgcatggcagcctgcaactctatctggtatctaagacctagacctcgagcgagatttgctaaccgacttggacctgcgttttccattccttgatggaggcgacttggaccgccctctggagctcttgctatccgagcgagagcgacttctgctcactgacctacgggtacgtgatcttgacctacttcgtctgcccctagatctccttctgccgcggttcctcctttgaggggaggagggccttccataccgggccatctgcactctgagttccctgccgtccatcatgcgtccatccatggcgtctagcgcgtcctcggcgtccctcttgtcataaaacctaacgaaagcgaaccctctgctttctctcgtgaaacggtcccgtggaatataaatgtctcctacttcaccgcatctctcgaatgctcttctcaaatcctcaacggttgtacggtatgttaaattgtcgacttttagggataccattccctcgatacgcggtgcaggcctaccgtaactcattttggatggattcaatcaataaaactggataaatgaagtagctttcaccacaatgctattataaactacgcttccactgaacaacgacaaagcattc

SEQ ID NO: 698 - DNA, 2374 bp, Leptinotarsa decemlineata
  Annotation=Oligopeptidase; Tribolium gene name from OrthoDB database=TC010332; Blast E-value Tribolium Gene vs. Leptinotarsa Unigene=0
tttttttttttttttttttttacctaacttaaactatttattaattaacatcttaatattaaacactcaacttgcattattttatttacttttggctgggtgcgatttttttcaaacctaaggaactgagcagagccttcggcgaaggatctcgaccgcgaaactctctgaatatttgtcctgaatgaacacttcctcctaacgctaagaaagagtttcgataccttttacctacttccacaatttttttctcatcacctttaacttcatggaaggcactatatacatcggcggctatcatccttgaccaaaaatgagaataatacgctgcgccccattcatcacaaactatctgagaaaacgataggggatgtgagtctattttgtgtaatgggaaacacctgtattggggccacaattttttcactatgtctaaccaaaagtcttttgtagagtgtagttccaagtctaacgatgacaagtacagttcacgtgataaatcagtaccagccatgtgtttgttcacgttcaataccgactgatacatcttctctggcaacttttccccagtttcatgatgagaggttatgctatccatcacgtctttgtcgaacagccagtgggacaatacgtgtccacttacctctacagcatcccattcgatgtttgataatccggaaacttctaaataattcgtacgtgttaataaatgctgcaaagcatgtccgaacttgctgaacaaagccttgacttccttaaacgataaacatggtgtcttgttgtccacaggacagtcgaaattgaatatgagagcagctagtgggtttctttcagttaaaatgcttctattttgaacgccaatcataaaaccattgttttctatcttcattctctgctcactcctatcgtaaggatcaaagtagaatccagctactggagcgcttgtgtgggcctcgaaaatatcatagaacttcacatccttatgccacttcgaaatgcctggcctctgctttatggttatatcgaacagcttttcgcacaacttgaacaaaccttccaatacaacgttgagctgaaaatacttcttcaattcatcatcgctgtaaccgaactcactcttttgttgctttctcttccagtaaggcacatcccacagttctaacttctcatgttgaaaccctctttgtgcagcgaattcatgtaaattcttcaactcctcttcctgagcaggccttgctctttccaacaaccccgagattacatttttcacctccgacaccttaccagccatctttgtttccatcgacatatcagcataagtttcataccctaatatgttggcaatatcacgctttatgtaccttatctcgtccaaattcaaaccagtccttaattctctctctccatagttggatcctcttccgaccaaagcttgccacatattccatcgcacctgacgatcagagcaatattccatggccggcatgtagacgtgaggctgtagtgtcagtttccaaggtcctttcataggataacagggatcagtagacgtcactttcagtaaatccacaggaaagtcccgagttatcgttccgtccgtcaccatatgggaaaacatcttggtggatatttccgttttacgcctaaactcttctttaagtttgttgaaagtattggtatactcagtcaggatagttttccctcgagcatcaagttctaaaccgttcagtttaccttcaatggcaaatttttgtaaaagtctaacttcttcgctactgtactttttgccattttctttagcaaacttcacagcattgtaaataccactctgagtatacttagaagccctcgcttttcttgccctttcatgaattgccaggtagctggaagtgggcatcaaagtattgttgccaaagtataaagttttagacagaccccaagtgaaatctaaaggagcagtaagacgttccaagggctggaacatctctttgaatatgtcttgagatagattagcattcagagattcatctaactttttgactccttcctcaaactctaaggtctgctttgcaattgctgccatacaattttcgatcaaaatatttttgaactctggtaagccgtcactcgagatgaaaatattactatcaggtgcctcctctccaatttctgggataagcacgatatatcctctttgagatacattggaaatagggatatttcttcgtgaaaaacgacttgaagacaaaagtaatcggaacatcttccaagatttcttgcaaaatgcaacattcatttttaacttttcaaataaaacatttcatttttaatttatatacacaacacacaaccataaatacataatgtatcagtc

SEQ ID NO: 699 - DNA, 5006 bp, Leptinotarsa decemlineata
  Annotation=N-acetyltransferase MAK3-like protein; Tribolium gene name from OrthoDB database=TC008129; Blast E-value Tribolium Gene vs. Leptinotarsa Unigene=8E-81
gagtggtactacttttattacaacactgtagacgtattatcaggacactaatatatatacaaaatttttacatttatagacatggtgtctagaaaattgcatattaatttatatagtaaacccaaaacatttattcaagcacatgttaatcttaaacaatgaataataaatattttttttgtgttccatctgtatgaaattgatacaaaagctaatttctccccatctccagataaaaaattctatgggtaaatattggggtacgagggagttacacctaaaaataaatattacgaccaaccccagaaaaccaactttatcgtatccaaaaaatacctaatgttttcctttagaatgattctagttcaactgttccacacttttgtgatccacattcattttcggtggtttatagtgtgtgtatacaaagaaaggaaccagttcactttcggtaaatttcacagagaaaaatatttctgaataaaacgatgagtccaacattatgagaaagaatcccatataatggtgtatcgaaatgtctaaaataaaaatcaagtgcaaaacaataattcaggaaactctgaaacaaatgaaattttcgaatcaaaacatgtggaaactgtgtaaacaacatggttaactttttaaagaaatgagatcaaattcaaatttagactttagtgaaatatatacaataatggaaatgtcataccgggatgttaggaacggtaataatgaaaaaatcaaatggaaacgtgtcctattttgatttccttgtctaatcttcaagtgcagatatggagttgagaaataaaatttcaacagaagcatagaaggatcacaagtttctattttaagtttcaaaatagcaacactcttcactctgagaagagtgtttgttggctgaggactgcaggtttttattcctgacgtacaatctataactgcgttagaagttataaaaagcaattgggcagcggaagatgtgctttagttgtcctcagcatatattacatcgttcagggttgctttattacctttgatatctaccacagttgtagcctgcagactacgccaacaaacacggaaaatagctttgacacagtgatttacatagtattcatttcaataatatcttgaaaaacgtttttatttccaataatttttttttagattttgttggaattattttttttattttagtttcggattggaatattgtatatattttagggtgatatatgtttgaaagttatctgttacattataagagcattcgtgacaataatttgtaaaactcaatttaccaccctaacttgagcaaaggttaatcactttatattacatttgtcccacaatctggctaggagacagacctcgtttcttcagaagtatacaaattatattgatctatttaactgcactttttcagttggaatcctcttttatagattacagtggcaaaaaataagttgaaaagggttactgttgctaatgggtgttgttcatgaaaaaaaaatacaattgtgaaattgacaccctttagctagtgcatatttttttaacttaaaatataagattattaaaatcgtaatagtaaaagatagatggtttaattgtcgccaagttcactgttttagaatactactggatggaaccttgaaaatcgattctagctattatagttccgtaagatacattaccagggtatcgaagttattccttactttacctatacacacagtatataaccacagagatggcaatcgaagctaagttgggaattacttactttctgtacattatagtcacatagaagtcatatagaatccaatttgtttttcaaattcatataagttaatgtgttacactccagagattttaaaatataaggttttcaccgtgtccatataagttacataaaatcataatattacagcactatttttaaattaaatgatttatttatgtgaactgctgtcaaatattacaattaatgacaaatataactcatgataaaatgttgaaaatgaaattaatttcagaaaaaaaaacatcacacattcagatgattcatttaaaagagtattactactagcaataaatgaattttttactcttgctagttgaaagttccgattttcatgaattttgggtttttacttttcgggatgtgtggcataatttcatacaataaatactaaattcttccttaaacatttgcacatgcacttcagcagactattgtcaatagctttgacagagtagagttgtgagattttctacaagtattacacatgaaaaaatgttatgatgtggtatttgtttgatggacaatacccaagttctgattaaagcaaatacctcatttatatatatcaatacaagttctcagtagatactttgatcgacttctttttctgaagtaatcaatattactttttttacctttcaattaacttcctggattcctcacactgttcatagacaataaataatattgatatctgaagaatgaaactttcaaaataatatgtatgaacagacggtcttctttctggcatatcaattgatttctttcaaaaaacaatttcaagttggcttcctctgaaatttgacttgaatggaatttcatcacttggagaccatgatgtctatgatttctgtagccataccattctaatccctcccaaagatttcaaaacgttcaacatattttataaaaagatttaaaaaacatataagtcatttttgaaactcataactggcatctgaatgtatgatataatatttaagtaatgccatttatggcaaaaataagatcatttccatgagtgatgtcataagatttcaattaaaaagtattcattactgaactgattttgataccgaatagattttaacaattatggttatcacaaattcactaaaatacaccgaaagacaaaaaactgccccaaacttttggttgaattattcgattcataacttttgagttagtaagacaaattgcaatatttttcaatcttaagtcaacgataagtttataattccacatgagtccttggaaaatctatattgaaaacatggtaacgcatagatttcttgaaatgtttatttgtctatttactcaaagaaaagagaatctcaaaggttaggaagcgttgaacttatgaaaattttgagtgtttcagtttttttgtctttcatttgcaaactatactcatggatatgaaataaaagatatcttgaaaacacacgttgaagaaaaaaaaatataacaaacaacaggaataaaattttcaacagtcaactacttcattctaactaaagtccaggattcaagaagtaagagtaagttgatatagtaaataatgttaatagactttctgatcagtttgtgaacacaaaataaataatcaactaccttgtttttatcacttcctgttttgaaattaaccctgaactctttgaatcctgaactagaaaccaaatcacgtgaaaagtgtaatatggcatctgaaaaaattagtcgtaataacgtccaaatactcatctgagccataatttcaaccgcagtgcatccacaccatttaaatagtatctgaagagtctcttatctcgaacaaatcctagcttctcataaagttgtaatgccggtttattagttacttcggtttcgaggactacttcatcagcattaccctgtaacatttcgctaatagccattcgaacgaggttagaaccaattcgaagtttgcgatacttttggtcgacggctaacattgctatgtaacctcttttgatcactttacgatgaaggtctaatttgcatacaattgcacctacacattctccttcacacattgccagaaagcacagctttggccagttgtggatgaagtatctgtatgtgtaaattgaataaggttcggacaaatctttttgaatgattttcatgatcattggcatctgcatctcagactcgtactgtataaaatctatcttgtgctttgtttttagagaatcacatgacttgagttcgctgtcttctaactggacattttttaaactatctgttatctctgcaacatgctctctggtgatgtttaaaattgcttctttgcactgtgtattatcttcactacctcttatcaaagtcgaactacttgaggccccctgatcgttattcacattgtcgatagattgtgtttggctaacagattccaattcattcagatcaggagttgggatattatcacaagaaatattataattagtatctaatttttcatcttcagagttcagattcttagtgccatttttattattatctacactatttacagttctaacatcctttgaaatttcatttttatttctgctactttggtctacttttttttcaacttcgtgggcagtcttcgccaagtgaattgtttcagattccttttcatcttcaatatttacaggtttatcattgttttgcttacattttttacctttaccatttcttcttttaactggtaatgagtcatcttcagctatccatttgcaatgccattcttcagttctgaattttcgaggcatttttcacttaaaaagcagttcttaggtacatctttgatctttttttcgtgtgcgacggaaggacacttatcaaccttactttttttattatgagtcttgttcattttttgcccagaataatagaagaaaaataatcacctatttattcttctcataacattgctggcttcaaaaagataaaaatgttagatgaaaaaataactgcaaccaagacatattgatgtggaatttagaattaagaggaggaagacagggatagggtcttgaaggttgaaggattatgtagttctttatttgtaggttattattcctgtgagctggtggttgtcaaaaaagcagggtgaatattattttaacgccttatttaaacaaaaaaccaaaatccaacctaacctcacctccttaaactaatatcc

SEQ ID NO: 700 - DNA, 1785 bp, Leptinotarsa decemlineata
  Annotation=Sulfide quinone reductase; Tribolium gene name from OrthoDB database=TC001316; Blast E-value Tribolium Gene vs. Leptinotarsa Unigene=0
tacgaacaaatatatatttcttaaagtattaacaagcatataacgatattttagtcatctacaaaaattctatggcaaatatttatacaagtccacagttgcactgcagattcttgctccagtagtcaaccccccacaccacattctgctcatgtatgcaacttttccttctttccgttcaactccaagtgcatgagttttctgaaaggagcaggcccattccagtatccattgagcatcaagtgccagtacaggggcggcatcaagttcttttttaggaaatacatggagtacagttccctgtcctgactgaaaggaaaggtctccaaagggttcaggttatagtcgaattctgccaggatgcatttgtcgtaacccgtgatcaatgggcaagaagcgtaaccatcatatgtgttttggggctcttgtcccttcattactgcgctcaagttttcatagacaactgcgctctgagcggctgcagctgctgcagtcttcgaatttggtgacgaactgcaatccccaattgcaaaaatattggggtatctcaagtgttgtaaggttgacttatcaacatcaacaaaaccagcttcatttgtgagatctttgttctgattcaaacattctggagttgacataggtggtgttacatgaagcattgaatattctaccatggttttgatatcgggtttatctaagttctcaaacatggcttgttgtttatcagagtcgatacttattaagtttgttctcaagtttacatttatgtcacgctccttgcagactttccacaaggcatctgcatacttcttcaccccaaaaatcacaggcaaggacgtattgtacattatatttactttctctctctttttattcaacctcaaatagtgatccacaagatagcatattttttggggagctcctggacatttcactggagaattgggaaaagtgaaaatagcatttcccccatcaagaaccgacagggcttcaaaagttctgtcaacatattttggtgagtaattggaacagactcctcctggcctgctcagagcatctaacaatcctggaatcttatcatagcgaagatctaagcccacagctatgagtaagtaatcatactctatcgtatgacctcctgttgtatgaactacatttgccttgggaatgaattctgcagcttggtcctgtatccaaacagaattcttgggtagaacatctttttcattccttctagctgtttccactgatcccactcctcccccgatcagagtgaatagaggctgataataatgatgttcgctcggttccaatatgactagatcctttttattgagacttttggcgaatttggctgcgacagcgcaccctcccgttccaccaccaacaatcaataatttgcagttgtgcttatccctgttgagaggggtagttgacaactttgcagtatgtaaaataggaaaggctagtttgaaatttttgaacgctagtttgtagatcattttagggtatggcaggtgataataacctcgatcaatagattaggatattgcacataacgttttcattgtaatcacttgaagataataatcatattttcccagtaattgccatatcagtagcttgttgactactttcccgagtttttatttacaagttttgtctggacagtttgaatacgtttggaaaatgggctatttttaatagtattcttaaactatttgttattattacactattaccatcatctgatatgtctcggatatccggaaatgcaatgaatat

SEQ ID NO: 701 - DNA, 1426 bp, Leptinotarsa decemlineata
  Annotation=Prenylated Rab acceptor protein; Tribolium gene name from OrthoDB database=TC014897; Blast E-value Tribolium Gene vs. Leptinotarsa Unigene=4E-93
aggtattgtaaaacgtatatcaacataaatattaaatgcacacacctatatagccagctcatcagcttcatttgacatttcactatcaacaatttttccataaatgaatcaaatatataaaaaaaatatgtttattgtaacattcatattttatttacacaagtttttcaattaaaataatgactgatattgaataaataagttgaaatcaaaatcaatttttcaaaactgaatcagtcatttgagaagcccatcttgtgtgtgcgggacaccacctgtcccggataaaaaaaaaacaatgcaaacaccatagattgtattaaatgacggatttgtattcattgacacttttgactttctttacgagttttggtctgcagataaatggggtttctcaaatgactgtttcaattataggtcttgcctagcaccacaatctaggtaattacattgaaaaaagtatttttcccctggaaagactgaacttaagataaacgcgatttataaaacaatttatttgttaattgcactgggacagaatcatcattcgagaaatcttgatataaaaattaaggttattcaaaaacttacctttttcatctagagtttcaattgttgaaaccaaatagtttatctagagttcaactaaacaaacatttttgaattataattcaactattttgtttttaaaactaggtagaatgttttatacaggtttaaattcataagattttattaaatcaaacttcttccaaaagtggatatgaatcatcctcgtgtgcaaccaaagcttcaatattataaaaagcagcatgtaacgttattaccaccatggaagcaccaattacccaaaataatgctccatgagcaccaacaaaataatatattggcattgagcacaaaattaaaagtccgtactgttgagctatagtgagctctttcccaagcagcaccaattttctctctgtttgccttttattcaagcggtaacctgcatagaatgttccagcaagaacaaacaggatcagtggtgaagttatcaaacaatagataacaagtcctagaaatacaaataaataatttgcttgaaagtattcaatatttctcattattcgctttcctagcctaggaattgaaggaggagctttgaaatttgacgtttgaatgaaaactaaccatggccttacattttgtctttggtgggcaatccattcttttggatcgggtatttttgaagggatttgaaaaaactaggtaatttattcttatcgccaagactctgaagaggatccatcacaccagaaacatccactgatacatcagccattgtctcttttgataattactgataactgatagaaaattaaaaaatataaatatactaaaaatgaatgacgtgttaatgtttacaaacagtattgaaact

SEQ ID NO: 702 - DNA, 1371 bp, Leptinotarsa decemlineata
  Annotation=NAD-dependent deacetylase sirtuin 2 homolog; Tribolium gene name from OrthoDB database=TC002584; Blast E- value Tribolium Gene vs. Leptinotarsa Unigene=2E-62
ggtctatcaattgtcaatggtcattggttatttatttagaaaatttgttgtgaataacaaataagcaagatatgtaaaaacaaatgtaaaataaattggagttaattttgatttgaataaactcatattttcttctccgaattaaatatttactctatttcactatgtcctcaggatctaaagttcctgataatgcgtcggctggatcaatttctagttctagtgatagtacagctggaatgagtatggatcatttacgacggtacctagccgagaagctagggttttacgataaagaagaccaggcagattcagaaaaagtgaaggtattagataatgttagtgtagatggtgttatcgattatataaagaatagaaattgtaaaaatatcatcacgatggctggagctggaatatcaacctctgctggtattccagattttcgatcaccaggtactggtctttaccacaatctgcagaaatataacttacctcatccacaagcaatttttgagctagattttttcctggaaaatccaaaacctttttttgaattggctaaggaattatatcctggtacattcaaacccacaatttctcactatttcataaaaatgttacatgacaaaggcatgcttctacggcattacacccaaaatatagatactcttgaaagagctactggattaccaggagacaaaattgtagaggctcacggaacatttcacacagggcactgtttgaagtgcagagaagaatatacacaagactggataaaagaaaagatttttgaaaacgacatcccaatctgtgaaaaatgccctggaattgtaaaaccagatatagtatttttcggagaatctttaccaaccaaatttcacactctacttgttgaagacttcaaaaagtgtgatctgcttattattttgggatcttctctagctgttcagccatttgcatctttagtagacagagtatcatcaaatatacccagactgttgattaaccgggaaaaggccggccaccgttccggagtaatggctctgcttggtattggtggaggaatggactttgactctgaggataactctagagatgtgttatggctgggagattgtgatgaaggttgtggccttctggcagataagttaggatggggtgatgaattgagagaattgtgtgaaaagaacatgaaaggattcagaaggaggctgagaaggaaaagaaaaagtcaaggaggaaaagcctgaaaagaggaagagttggtagaggaggtactccaaaaactttgaatgaaataaaaaaaaatagaacgttctgtgtcaaaaacgttttattataagttacaaataaataaaatcgttgatattg

SEQ ID NO: 703 - DNA, 3165 bp, Leptinotarsa decemlineata
  Annotation=Syndecan; Tribolium gene name from OrthoDB database= TC010796; Blast E-value Tribolium Gene vs. Leptinotarsa Unigene= 8E-5; Blast E-value Tribolium Gene vs. Leptinotarsa Unigene=0
ctatagtgattattagctgaatatttcaacagtacaaggaaaacttaggccaccattcaactaataaaaataacgagcatgttcaacattaattttgtgatactacaataaatagtgtttcaaaattggtttcacatgaatttcctaacatcaaatttgaactctgaggtaaaaaaaacaattgagtgttaagtcaactaattaacatttcaactcccaaatatttctgttttgaatttgacactgaacagttttcctttctcagagttttctacagaccaattatttcttaatcataacagtataacaacaacgtgcttctgaaacttcacatattgattacaactgaaaaacacagaaatgtgaaggataatatgaagataccagaatcattattttttattatctttcaacaaatatatgacagcatattcagaaaaataatatatcagaaatttaaaatcataaaattaattatatgaattgaaaacaaaataaaatattcattaaaattatttatggagcattcatgattgggggttttttattttcatttttttttgtatcaccaatctattcataaactgataaaaatattgatttatcaaagaacaattcaattattttcacagttatataaaaagatataaggtaggtacattcagtttttcatagtccaggcccaatgttttataatgaaaatgtttttatatgtctttgccttaaattataatttcgaaattccagcttccttcaataatatttcatagtcaagtcgtaaaataattgccatataaaaaaaaacaaaattgatagacccagtgaaaacaatagttgccaacattcatatatcactaaaacaactgcctttgaagtatactgaaaatataaaggtactgaatacagtttaaaatgtaatctagcaaaattaattcaaaactgtgtttgtgtctgtgacatttgccactaaaaattaatattttaatgattttcgctgcctatctggcttttttaccttccaatacaaaaatgaaccaagctggtgaaaggcaatttgaaaagttcaccccaaaaagttatgacattatataaaccaccgaagagttccattagttagtaacttgtcatacgaatcaaataatcaatggaaaaaaattaaatttttatactttagatggataatttttcacaaagtgaataaatcctttccattttcaaagctcaaaaaaattcacttctgaaaacgcctcaaatggaaataggtatatttcctttgacaaacgtcaaaagaatgaaatgtccagatgttatatttgccagtctacatgaatacagagcaaaacaaactaaatatagaagtaattcaatttttttccattggttattcaatttttagtttagttcagtggtttatataatgcagtaacttttcgtagaaaactttcagtttgccttttattgacaaaatggtttagactttcgcggctgaggttttcagtgtcaccgttttttcgagtttgccttttattattacccttcagcagattttctattgattcagctctttttgttgtcagaaatgaaaaactcaaacagcaagaaacaatgctacacaaaatatgtctttcaaatgatataattttaatattttgaacctctgattgaaatttaatgaggatttcaagttaaaacattgtcttgaattttgtgatgaaggtatctcagggcaaacatactaatttattgaatttatttcaaatattctaaaaggaatgtaactttagtatcattatgtgaataaagctgcactataagcatctgtaaaatcctgcccataataacttaaaatatttcatccctagaatctatcattatattattactttaattattactatatatttaataggtacctttaagtatagtttgagcatatagtacattgttaaaatagatatgctctactaagacaacaatgaaaataaaatattttctacacatgaacacctgaaaattgatcaagattgtactatatactcaaaatcaaaatggacgttaaaacatttagttcttttgttacatttatatatacatccaaagaatataagatgatgaatcaatttgaaaataaaattataactcgattatccactcacactgttggcagtttttggcaatagaagacccaatctttataaaataaatttttaaacgttccaataaatagacgaaataaatagtccaaatgaactgaattaaaaaaattcgaaaaagtacataatacagcattatgtgcgttttttaataatgagtatgtcttgtaaatatccatatttgacgttgaagcttcactacataagcagaagattcagtccctaatgtctgcctgagcctttctgatgagcaattgcagactctcaatataatcgtccattaccttcataacactattttcaggcgtaaaactctttgtttgtgggtgctctgctgtacgaattcgagtttggcgattgcttaggttcgcccaaggcatatgatccttcatcttttttgcgcattctgtatacaatgaacattacaaccaatatcgcacataataatccaaccacagctcctccaataacagctgctaatataccaggttgagcgaagaaagaagtaggacgatcatccggtttagggttcatcctgacactggtatctggagtaggttctggagctctcttgggttctataggaatttccttgtcaatgtctaactcgtccggtcgatttcttggcgctgttggttcaaatactggattttggttgatataagttgttcgaggtttctcaacatcaggttcgtggtcgtcttcatcatctggaccaaagccagatccactcgattcgaggtcatgggtcacctccccattgtatccacttccttcgatggccgaatcttcttctttgaaggttaggtcactggaactactgcgttggttgttctgtgctgctgtcgcaaatccaatgaggactgccaaacataatgaagtttgtatccttaaatgcatcactaaaacagtttttaatccttaagtttctagtttattgttacttaaataataataatatggcacaacacacaacacaacccactacagcattgaagtaaactgatcaatc

SEQ ID NO: 704 - DNA, 1094 bp, Leptinotarsa decemlineata
  Annotation=Brain peptide IDL-like protein; Tribolium gene name from OrthoDB database=TC004766; Blast E-value Tribolium Gene vs. Leptinotarsa Unigene=4E-76
ttatgcacagccgctaagaggccgccagtcgaagaaactggaagttttctcaaatctctcttagcaagtcatggaccaaactatttagaaaagttgtttggaagcaaagccagagatgccctcaaaccacttggaggagtcgacaaagttgcaatcgcattatcagagtcacaaacaattgaagattttggagcagcattacatctgatgagatcggatttggaacatttacgttcagtgttcatggctgtagaaaatggagacttaggaatgttgaaatcgttggggattaaggattcagaattgggagacgttaaatttttcttggaaaaattagtcaatactggctttctagactgaaccatacttgaccctgctgctattctcttcgcccatcctcaacctcatatacctttaagtaaaaatttttactcataccttccttattaagtctgtctgtctgtctgtctgtttccttattcagcagcagagtccgttatgatccgtcccctatcattcctttgaatcttcaaccaaatatcggcgacccctttggctgtctcgaagggtagccgacaattgacggccaatatattacagacttatgaatacatatcaaagcatcaaaggtctttgaaaacggcacatatcatgttagatgtaatattatgcgataagtgaatttgtgatcacatttaagaaaccacagattgatatttattattagtgaattgatacttaatataaatgttatttcagatctgaacgtttttgaaaggatgtaactcaatttactagtataattgtgaccactttggagatatatacgaggtacgacgtaacaattattgtggcactaatttagaataagaatagtaattagtaaagacaccggctggccgggttactcgaaatgttttactgtgtgaagaaaatgtgtagttttgtgaaaactttgttacaatttggtgcagggtaacaaagtgccgacatctctacgttttttcataccatggaaaagattttgagagcagaagaaatgccaattgacgaacggataggtcgttagcgtcagcgttttgaagggcctaatg

SEQ ID NO: 705 - DNA, 3680 bp, Leptinotarsa decemlineata
  Annotation=Putative uncharacterized protein; Tribolium gene name from OrthoDB database=TC003537; Blast E-value Tribolium Gene vs. Leptinotarsa Unigene=0
gaccgaacactttctactttgacaatagcggccaaactaaatctaagtcattcagcaattctaatcccactcctgttttaaaacagacgaaaaaaattttcttctttcaatctgcatcccagtttccgatcaacttcggaagatcatttgcccagggatactatcagcgtatatttggcagataggccttcttcgacaacccctgatgctaacaaaccccaaagatatatcaccagaagggaggaagttaaacccaataatatcggatacaattatttgacggataagaatccaaggagccgtaaacctatattcataaaacctgaagataaaagtagtagtaacgtcgactgtaatattgaagctggccagaaagcgttagacttctggaaacaaattgatcgacaaaacatcaataagccgatattgaagaaaaccagatcagatagtccacaaatgtttaccagtcatactagtgtgcaaaccaaagtgtttttgcctagcgttcttcaaaatgataaaagtaaattgaatgaaacacgcagtcctagtccattcaaaccggctactccaactttgcaagaggtcgctaaaacacgggttgaatcgccacaaacacctttgagccaagaagatacaaaccgaaagtcaaccaatttagaagaagcgttagatgaattagaagctatttataacagtttgaggctaggtgatgaagatttactcgaaagggccgaacaaagggaaaaagaagcccaaaacaggagagtaccagcggatattatgagttcatatccaagtttcacatctagaggagctatgagcgattctagttttagctatgagccattcgattcggttgactcaccaagacgtaggagaatgatgaagaaaaaccacacgttagatgtaagaaacgatgacatggcgttcaggaaaatcaataaagaaagagcaaacaccatagctgatccacaatcggcattatccaaagtaagttatttactgtcatcgcccgttcataaagctctcagagatgaagaagatgagacccaacatgcccacacggatgaaccggatatcacgtttgatgatgttgtttatcgaaatgttaaacacaccaataatttgttgaaggttgcagatccacaaccacctttcggcattcccttaggaccaattactcctggtgctaatagtgactatcttcacgccaagcctgaaaatatctacaggccgtcgtttaaacctcggaaaatacctgatattgtaaaggatgacttagctttccgaaatcttcgcaaagatggtaataaagggccagctttgcctcctttatctgttgatgatttcaaaaataataattcagagaatctggcgagtttgaagaaaatgagagctcaacgatctctttctgctaatattggcgctttaattcacaatgatactctagagagagttcgacaaaaacgaaaccagaataacgacgtagaaaacgagtttaaaacattgacagatattgctgacgctatggaaatagccagaaatgtattgagagacaaagaaaacaaaatatcaactactagaaaagccttcatgagcgatacagacacaaagtatgttcagccggtaactaacacatctagtcttcgagaaagcagacaaaactttttaaatggtttgaaaaattccgttgacaagtctacccagatatcgaaaccgtgttcgcctaggataggagagatcaatttatctgccaaaccgcctcgtggcctgacaccagaaagccgaagatctcctaaggaatcaactccaataccaatttctcctcttcagaccaaaagtgaatcttcttcttcgtctttagacgacctgttaagtgctttggcagaagaagctaaggaaactactgaacggataacgaaagagctgaatctactcaacgaagaaaaagaaaccaaatccattcctgagcagcatcaaattggaaaaggaactgaagcggaagttgataaaaagttatctgagatcgacgctgtctcagaacatgctaagctatgtgaaaaacttttggaatgtgtagtagatagcacggaactgatggcttctacaaaaaatgacttggaagtagtggagcaaataaattttgaacctgaagaagagcgttctgccaacgtggtcgtatctagaatagattccaaggaagaagacagaaataatgaaactggagactcggaacacgattatgagaatttattgtccgacaaagaacttaatgttgacgaagttgatgtaacaacttctctgcaagaaattgatgaacaagagaaatgcagatccccttttgaagaacacaaatccgaactcattgcaagttttcaggaactcaggaacaacatggcggatattgaaatgcctggtaagaagagcgatgaagaaatcaattccgaaaagaaatcgtcatcgaaggtggattctggctacgaaaatcttgaattgattgagcaaggggttacaggtgaggaatcgtgtgctggtgttctagacgtttttgctttgccaatcacagaatgtgcctttacctctaatactaatcccttagatagtgagcctacatttacctctacatgtgatataattctgaagaaaccagtcaatttcaatgcacatgatgattcagagaccagctctggttttcactcgaactgttcttgcggagaaaattctcatggccccaaatctgatgcagctattgacgatttagatgtagccgcattagattctctggaaagtttgaaatcgccaagaatggttctagagacttcaaataaggtttctcaagatacgaattcattcgataagtcacgagaatttccaaagagttcaaaattagttatggaattgaatgatgtatcgaacagaaaaaattcaaacaatgatgatcagcctggaacatcgtttgatatacaaccccggaattctttaatgacgagagggatgcataattcaagtcttggaacttgtgacaagaaaccaaccaactcctggtaccgtgaccctgctactctggcatttgcatgctcctacggtattgcatgtgcccaccaattagcatccattgatttatttgctattctgagcattttgtttgctgtcctttcattcataacggccttgtttctttaatatcataattgttttagttaggctatttatataccttaccactcattcatatagtcataacagattgacttgaataaaacagagaatgtagaaggggtagatagggaaaatcagtttatatctttgatgtgactcgaataaaagttaactttttcatcgaatattttaagatataataagtttcatttatgtgataaaaagaaataaatttgaatgaaaaacgaattttatgaaaaaataaatgtgaagtagtgactattacagtgatgcattctggttccgtatatggagaatagatatactctgaaggagtcatgatagatatctgttatggtctttgttaatgatttttatgtggtgttctgtatagctgtacatattttgtatcttttgtaaattactatcttgaatattttcaatgccaaatactattttaaaactatagatttcattgtcgataatgtttatttttacaataaatcttgctgtaaacc

SEQ ID NO: 706 - DNA, 5740 bp, Leptinotarsa decemlineata
  Annotation=Nuclear pore membrane glycoprotein 210; Tribolium gene name from OrthoDB database=TC009803; Blast E-value Tribolium Gene vs. Leptinotarsa Unigene=0
gagatggtattatgtacatatataaacctgagttcttatttgcagtcttgtaaaaaaaaacaataatgaattttgcagtaaaatatcatgtcccccacatttaattcaaccttctattcctccgaatttcaggactattataaaaagagcttgcatctccatatattggttcccttccactggtgtttccacaacaagaacaattgaatctgcaggacgtttggctgcgattaggagtgtttggggagatggttggagttattcttgtcatgttagcagataagtttgcagcacaccgatgggaagtttgacttggagtaaatgattgggtgggagtcaataatctactcggattgacattgacatttactaccggctgcatatagtttgaataaaagtaaaatgtaaggaagaaaattatcatcatagcaattgccatagctattgcatatttgtagttttgtaagaacaggaacactggtgacctgcccaccgaacaaagttgtttttctaaatttccagtgactttgacaataacctttaaatgctgtttggttgatggtgatgatataatgatacccatagcttcttgaatgtctgccagtctccagtgataatcaaccaactggatttcatattttctggaagtttcattaacagatttacctttgctgacatagaggatacttgtatcagctggatacacctctatttgatcaagcacttctggtagtcctatgactgtgacttcacctgtaaaaacattttctgccaaagtgacttcaggaagtgtaaaaacaccgggcaaaaactttatattgagttgctttgatgtgatttcaccatcttcagtagaggcccagagtaacaagttggttctcaatacagatatgtctattccacttactcccaaattaatcagtttgcatgcatactgacctgattcaggtacccaactgttggttacattaaatagttggtcaatagtaataggcagtgtatcattagagaattgtatgaagcatctgaatccatgaggtcttatcaactttcgaacatcagttctacacctccagccttgtatcaggttattagttttgatgccaattgtctcttgactctgcaagactagaatgactctgaccacactgttttcaatgccatttgttaatatcaaattcggatcttccaaaatttctatctcactcactgggtctatctggatatgaataggagcagattgtaatagagaatgtgtcaaaataacaactccttctttatttccaacaaagcctatgtcaagagctggattgatgtgcattaaagtgatgtcactgctcttccaagttccaggtgcattatattccgtaactacaggagtccacaaacatatcacatccccagttgtcaatcgactaagaatcggtctcactgattgttcaacattaattttcacgtagtctgctgttttttggataccttctgcccatgctttcaacatcgtattcccttcttttttagtataaatccaaacagatgcatcctcactaccttcggttacttttaccaaatcacacctactggttctaactttcaagtgtttagggcctccatggaatgtatttcctatattatcatgaaaggtggctttcagttgaaattcggtacctagtggcagagtcctgagaggactatcagagtgtatgcgccaattggcaataactttcagattcatatactggatcggtttcacttcaacgactattgataagtactgcttgaggccctgctcatcggtggttgtggccataaggagtgcatgaccaagaacaccataagactgcagtaaacctgtaggtgtgacggtaacaataatatcggacgttatagatttatcagcaagtagttcagtagaaggtgctttgtctcctggtaagaaatatgttacttttgatgaagtactatccatattagtttctaattgtacctctgagaacggagccataagcagtgaatttccgagaaaatttttgggaaacacaaacgagaatgattgaataacttcaatgtcaatccaagcagataacataactgtttcaatattctgaatgttgagagttggaccaggcactgtagcattgacaaatagtcttgtttttcctggtaccaaaccgagaacctttgcagctacccggtcagtttttttcttgaatacccctattgggtgaaagactccactcagatctactagtaatttgtcatcaacagtccacttgaaaagtattggaggatcttccaatgatccaagaatcatgggagatatgtcaggtacaccaacacaccaaaaaggtactgtggctcccactttgaatctgagtagggatgacacgatttttaaagcttgcagttgaacaatttgaatttccactgtatcttctgaatatataaccttttgtccagtagaagggtgaattcccactgcttgagcagtaattttagttagacctatcgattttcctcttatgagccccttttcggaaacggttgctatttttgaagaggccactgcaaaaataacatttgtatcagggtatggtccacctttaattgccaactgtatcatggaaccaacaaggattgacccatttcttggagacagtctaagaggttcgaaaacctgcaaatcaataggcgcacttgtcacttcttcatcaccgccagcaacggagaatacaagtttggtttcacctatttccactcctgtgataatgaagtgtacttcaccaactccccagggattggttggacttctctctgccaactgtatattggctattttattttcaaattcaggttgtaaatcgatcattccatactcaggactatccatcaaattatcattttcatcatacagtctcacaatcgctggtatacattttccgacttcaactttgtcaggcatttcgactcgaacaataccaacagaaacaacattaacaataagtgttgctggcctcgaaacaagacacaagtcaataagctgtattgtgagttccccggatttcagaggactgatttctatttctttagtactttccgagtatttgatgagagctatatcatctgagcttaatgccatttcaaaatatcctgatccttgttttactggaactgttactctgttgccgggatggttgaatattgttacaagattaggagacacaatggtatcctcaacaagaaacagagaaagagttgcggtaataggaggaagatctacgcctttgtcttctgcagatatgaatggtggagattccgctgtgacatgatgtttatgcaaaacggatgggttgtagcctcgaattgtaacattaagtaccaaactacctttgtctaatgatggttgaagggtctgatggaatttattaccgacaggaacatcacctatggttatgttccttggaaacactccagtattactaaggaccactccactgcctgcgggagctattttccaatccaaataaaagctggttatattcaaaaatttgttgccacagtcatcatagacagttacatcaatgtctatgttctttgtgctttgcaccaccacattaccagaactcaaatccatgggacacccatcaacatcggctattctcaactctggttgaagagtaatttttctaggttttccacaagtaactcttgtaatgatactgctcgttttagttttacaatttgaaacttcgggtgtattagagatcatcagtttgacgtcggtttctccaagttttttgcaaaaaacttgaactatgctatggtcttctctgggcatgatatggaattgggtaatatcatatgctagagctatgctttcgtcttcgctgactataattctttgatggtcagataaccgacctaagataggtctgggacctccaacaaagactaaattgatggatgttcctacagcaagcacgacttctcccttgggctctaatcgattcaatgttttgtatgcacttactgtgacggagtcttctagggctttgccattttgaaagtatgtgacagtgaccttgctggttcctacatccaaagcagtcatagcaatatttccacatgatatcccaacaggaggtagtactgcagtcttattttgtctaaattttgcatctgactgcttaatgtgaaagggtaattcttggcatttagtaaatggcagctgaatggttgtaccatctttttcttgttctgcatagagagcaatatgcaaataaactggagctccaacttctgcttccataacaaattcaactatttcaaggcgtgatggaggcaaaataataaacttggtagattgtcgattgtgatgattacgtaacattacagcagacacctcaaagaaaccattgctatgggtttttacatgacccgtttgactaaccataccaatactgtggtcactgctagaccagagaaatcttccatctccacctttagcgatcaaatcaatatcatattttggcctcgttaatgggtcccaaggaagtataacctcagagggggtgatggtgattcgagggtaaatcattaaatcagctttggcagtgactggtttgtcaaaccttactttgccagtttttttcattgaatacaccatccaaagaagcttgtactgtggctattcctgattttattccataacctgttaaccagctaccattgggtgaccgagaattaactaggaattccggagaaacttccatgtatatattaactgatcctccaacataaagtttgtgatccgaacttgagtacaagtctgccacaatgtcatgatgatcgccaaccaaaacagcccaatttctgtgaggtaaaatattcaataccaaataatcaggtttaacaacatgaaaatttgctgcaggtaatttcatcagaggatcgtttacaccaacatttctatctcgcaggacaatacgagtgtcaccttctttgagtgctgtaatattgccagtttttttgttggatgaaccaatttccatatcttctgcttcaagataatactggagatcaggtaaaacaatttcttccatacgcccatttttcaaaaaataaatcttaaaaggtaccgtatctccttgcataacatatacttctggaggcgtgatcagtaaatttgcaacaatcatcaactgaacctcatttgtatcaacatgtttgtattcagggtatggtaagcggacagtaactttagctgatccacttttcaccccttctagcaatatagagtaccccttttttccttcattttctagatttgctatagcatggggtgtttcatatggagaatccctaaatgtgatgtatcgtagaactgtgtccttattaggtccaagtgaaactatattccagtcaaattctacaccttctagtgttgaaaattcatttccttgatcgtcaaaagctttaacttcaaaatcctctggtgcttcttccatgaaaagttctcgagttgtggtcgatattaataagtcatgaatcacatcaaccattacatcacatctaagcatttgctttgtgtggacgtcctctgccaaaacaacagccatatttcgggctgcctctttagtgacagtactgacaacaacttttgtggagcattgcagttctggctcttcatctaaaggagttagttgtatgatatcgtttcttgttgtactccatttatagc

SEQ ID NO: 707 - DNA, 4491 bp, Leptinotarsa decemlineata
  Annotation=N-acetylgalactosaminyltransferase 6; Tribolium gene name from OrthoDB database=TC007223; Blast E-value Tribolium Gene vs. Leptinotarsa Unigene=4E-1; Blast E-value Tribolium Gene vs. Leptinotarsa Unigene=04
acagtataataaatatttgcgaatattacaggtcatacaggataagtattgaaagagctgtcttgcggatgtcttcatattggattgcatattttgtaaaatgtcttttatgggggtcaatttttctcggcagaagttatttcaatcaaactgactagaccttactccattaaaaaaaattgattaataaataatgattactttatttatcactgtaagtgacaataatcgaagtactctgagaaatattttaaaactgtttcaattcatattacatgtttttggcacttgacttgtgaccctatatattcatactacgatggaggcaaatattccggaatttctgatacaccgtttatatcacctgtgcttcaagacgagaaattagttcatcacaaaaaaattaacatacagtgagcagcgaaacaaattaattattttggcaatatacgtttgacaaatgtccaaatgtctcttataaacaaaaacttaaatttgttatttcttgggatatgttttatgaatcaagttgacatcatcaaaagatgaatatattagtttcccaagtgtatttaaatctaacaagatatttagcaatttcacacatcattgattttctaagtatgaatcacattattatactgactgggttgtgacctttatcactgttcatatatcttcatgtcatcctttgatatttccaaactgtcgaaagcttagtgccatgtaggtactggtctcaaatttcaatcaaagttcaattatttcaattcatatctagaaatgtgttaagcaacattcgagttttctggatatgtctgttctttgaaacgagatacaatagcttatatagtctgaccaacatacttcagtcgcagttctcccagcttactgcatgaattccagacttttcagttcccgtcattttgttttttttaagattactcatagttgatggagaaaatttgatgttttataatctacttttatgttcatcttctgagctatcagctatataatgacaacaaaaaaatacgggcctgcactttcttcgtcatagtatcacaacatttgccttaatcaaaaaatgatacgatatggtgacatagcaactggtattcaaacaaaatcgatgagtttatcaggaaacatacatttagaaaaggtcttcataaatccccgttttctaaaatacaatgcatcagaattttagtcaaccctaaagacaagatgctggaaactgagaattatattattaatgaaatgagctatgaggagtgtaacaaaatggttaggctagacaaaccattaacacttgtttcaaagagcacaagctgcttatcagaattcatagttcaggaaagtgcggttgtgcaaaacacaaattgaaaaatggccataggaaatatgaacactgcctacaattgtggaaagagatatatggcacaaaacgtattaacagtgacaaaggtccatttcaaacagactattgtttatattttatgaatcgaattaaaccaggcgggagcatttctgcaagttatcttttgtattctttttttttaacaaaaaattcagagagtttgtggaacatcggagtcctcttctactgtggaatccagcaactacagatgtacctccgtatatcattatcatacgtgctttttttcaaaagtgtgttgcacaaaaacacctaattctagcttagtgttggttaaaaaatggcatttgtgaaatttaggttttctgatggttgtttatagttatcacaaggatggttgtatggaggtgtttttgcaggttttttatttcatcagtcatcaggttcattatgtacagtaatttcctaaaaggaagccatgaaaatttatcaatagtgaaatgtattgtgatttccaattttttctgcttacaagcaaaagaatataaaataggaagtgaagactattttttcaattccttgttatatttgatactaatcggaccaacactaattgctttcacactgaatgcggtgtcatcgaatttttcttttttagaagtaatcctaattgaaatcaaatattactttttgtttgaatacagtacagaaatatatattttcaattttgaatactggctgtgtcagatttgagcttattttagggctgctatgtcaataaagaaaagcattttgaatagatatctaaaagacctttcaaatgaaaaataacccataatttctttcaaagatgcattgaaaaatatcagcattaaaaaatattaaaagagtcatatttcggaattttcgtcaaagtacatattttgaaaaataatgaatttgttctataatttaagggctcactgtataagggtgtctctcatataaaaaaatgcctatagaaaaatatttttcagtacaataacagattttataactaaaattccttcagctaaactataaaatgaaatattattattggattctaaggtacgttttttatgttcctttcatccatttcgaagacaaatggtgcaaaccttgaagaataaatatgagataaaaatagaaatcacttcagttgtttttaatgaagaagaatttttgccacacactgtagatatttctttgcaaatcacttctgcacacctacattctcccagtctgcaatcattgtcaagtttacattttcaaaacgccatttctgagttttggaatgttcatcacattttgtgacataaagtcgtttccttcccgggtcgcaatccagacacctcggatttcctccatgtaagaaccattgcttttccacatcatatttccaatactgatttcctttcataccatggcaaggatacagaacaacgtcagccttatcatttggatcagacacgtcgaaacaaacagactttcctttgactcgtaaatctttgtgccatgtgagggtaaaggtctgttgacctcgtttttttgtatcagatatgcattcctgaacttcgactggctggtctctgtctttgaatttagagtcgacacaaagctcaggagctcctaaatttctaatctctccttcgccaaagtctgatggttcaataggaggatatttcagaggtaaatcgaaagctatattttctataaaccacttgaatggtttgcactgcaacttttctcgaagagctttctgcctcgttagatctccaggattgatatttttgtagtgtggccgtctcaagtacaaatactgtgcatattcgtccatccacacttctgccacacgacggtagttccttccaacaaaatcgccttttccaggatttgggaaaggagcatacttcctataaatatgccccactcgggaacacggtgcgtcatacatttgaccaccgcattgccaaattttaaaactaagttcgtactgttcacctccccaaatttcaaggccttcatcataaccatccagttcccaaaaaaacttactgcttatagcgaataatccaccggccataataggactcttgaaaggctctgtgggatgcttcaaatcttccggtagcaaggggagtcttttataaaaaaactcccagtcaaaagcccctcttgcaccttcatcttgtgctcgatattcaaatgtttcatactgtataacatcgatgaaagggcaaacgcacgttttataatcttgagcaataggttctaataaaggtggtagccagttgacgttagcctcagtatgagaatctaaaaaaatcagcacttctgctgttgcttctctagcacctgctaacctggctcgaatcagtccacttctctctggtaaatgtatggctctaacttttgttaagttcgctttcaagtaagcatctaaaggtgtcttactaaattcttttgagctaaaatcatctacaagaatgacttctttcagtagatctggaggcgatctatttacaacactagcagcagtcctcaatagcgtggtccaatgttcgttgtgaaatggaacgatcacgcttactgttggaagttttttcaaatatttcttgtttttacaacctgaatgcctaatatccggtactgctctatctatagcaattttatcactaagagctgcattgaacccgttcaccttgtataatgaatcatagttttcattttcagactgacttagatatgctggttttccctgctcacctggaccaactctcatcgaatcccttttgatttgttggtaatcatgccagtcaattttttcattatcaactggtaaaaaaacgtctcgaggagcttggggttctaccccaatatttttagcttcaaagtacacattgtttgtattcaaatttctacttttgaatatcctataaaatagcactgtaaatactacagtcactgccgaaattaaaagatattttactagtgttttcacgtttcttctcatcttggataacaccacataggcatttttaagccggatggatttatctcattctacttatactgataagatggtatct

SEQ ID NO: 708 - DNA, 4007 bp, Leptinotarsa decemlineata
  Annotation=Type II inositol-3,4-bisphosphate 4-phosphatase; Tribolium gene name from OrthoDB database=TC003911; Blast E- value Tribolium Gene vs. Leptinotarsa Unigene=0
aagtgaacataataaaaaatatattaatatgtaactagaaaataacatattcaacaattagtatcaacatttaagtaaataaacatgactattagatgtaattggcaccttgagaagatcctgtatttattcctaactctgtgcagaaccgtatgttcctggaggtggtctataaagcttgggaaatgctaatagttgcatagagttgaaagcgtatttactgatgccgatattcttcaaagtattttctcttcggcatccctcgctcctcaaacagtccaatgctttctgaaattcgtgttcagctaaatggtattcgtcagctaggattaaacattcctccagagttattgacataccagtcctgtctttggcacttttacaacttgtgaatcttattccgttaatttgcctacatatttgtgcagctaaatgtaatatctcgacatttttggctttggaactatgtacagatgtcctaagattttctatcaaatcgttcagcgatctcagctggggcgagcaagcagacatcctgctggcgaacgcatttttatctggaatattcagtttcctatatctcaaataatactcattcagcctttcaaaattgtctacgttagacctctcctgtggcctagtggcgcctataccttcagctatagtcgccatttcattgattcctatgttgaaaaacactggtgtaacatgaaatgatagtgtctgtctagtgggaatcaagctgtacactgtgtcaggaaccggaagagaaactgtgagggaatttcttgttccactgactttaggattcggatgcggttcggtggctgggctagggctcctcaccagtatgaataatactgtcctcaaatcttcaatcgctacggacatgtcgccccacatgtctatctcgtttccgtagtagctcagcagaccttcgaaagaagccaaaggtcccagagcgttcaacatggccacaaatgctggatctggtttgtgacaccatagacgggtcatcaaacctgccaccaaagatgtcaatgcctgagaaaaacaaacatctcgcctgtatctcacattgcataccctttgtgccgctttaggatcttcctgcactctgaatacagagtgtgtcaacctggctgtttttaggagtccatccattgcttgcctcaacttcctcatactcggtctcaactcggcagaccagtcgcttattttgttcaaatctaagccatcggtgaatttgttaccatttctcacaactttattcactgctttcgacacggcctctgcttccttattgataatatttcccccgctaggctgatcggttatcacgttcctcttgacgttccgtgcgttctgcttcaagcgtactgcagggctgttacatctaccgcaaaggaacttgactttgctgaccaaacacataacgctggcttctatgttcagttgggtgatgtcccaaggttccggttcgtctgtgggtttgtagtagttggcagacggagagttgcacatgacattggtgtcgaggaatcggcgaccggtgtcaggttctagagatctaggctctgtattattcgtgttgctggtgaggctacttggttcagtgatttctgaagaattctcattgtgactttcctcacagtcaggaaataaaacaaaattagcctcatcaggactctgcatattcgaacaaagactcttaacaccttcagatgtgttcaataaattggtctccctactttgtgaactatcaatacggttattatctcgactctgattggacaccttccagatatcttccacattcatgggagtacacggagttgcgaaatcttccagatccggactcttcaaatccagtgatgtgagttgctgtgtgattcgtttgaacggagataaaatcaaactcggtcggccgccactttccaaacttaagtcttccccaacacccgaatcctcgttcacaattagtttgtactgttcgatgaaattcaaggcttcctcgaccaagcccgggtcccaaagactcagaaggattctggttttactgatcatatcctcgcagattggtaacattccgttggtttgtttttctttggccagtcgcatcagggtccgcattgcctctactacttcttttcttagttgcttgattgcctgtatagcatcattggccatagaaattttcgttgtgatctgataatttgagctagatttactcggcgattctttcaattgctgaactaatctaatcaaaccaccattcttcgacttgtgggaatgagctgtgaaagctcccacggtgatccaatcataaaaaccggatttgttgagggtatcattgtgcacccacatcctttgcaggtgcaggtttatcggagcgaactctaaactcctgtcgcctttgcgagaactggctttgaagagactgcccttgtgcgctagcaaattttccttggcttgtgaatatagtcgaagcaggtgcaagtgacgatccaataattctacttgtcgtgagtgccaaggttctctgagttcccccatcccagcgacctcttgtagtagttctttttcctgcagaatccatatatcgagtatttgtcttggaaatgagaaacagaggcgactctctgccatgtattcgtgtacgcagatatctccacccaagccggaatgaaatcgataagtttgcagatatggcgaggcgaacagaagtttcaattctgattggctaggtagtctcatctttacgcctaatctcggaggtaaagattgagatcttctgtgggaccatacctgagcattattatgagaagacattcgacaaggtgtatgttccgtactgcttcctctgtcttccacttcgagtgaccaagcgcttactgtcaaaaaaccggccgtggcctgcgttctggacagcagggggatgcggagacgagctgaatcctgtatggcactcaaaagaacacaagctgatccgagaggtacggcagtatgcgagaccctctccctgacatcgaacactgtgaatctgacgcgcgtctcccccgaaagaccgtcagaggcacgaaagctcactgtactgagaaatccagggttgctgctcctctcaattatctcagttcttccgtattgcacccaaaatttggaagatggcatataaacgtctactaccaaagacgggttagggggtctaccatgaccatcacagagtaaattatcacatgctaaagaaatttcacagagtggaacctcagttatatcaaacacatgtgtttgctgcaacctccacgtatgtaagtcgatatttggtttgtggttccttctcctttcgatacactgtcttagagcattgtattcagctctaataccctcatagctagcttgccttatacagtccatccaactggaacgctctatatctgaagtcgaagctaaagcctgactcaacccgccatcaaaaactaaataaaaaggatagtgtccttcagcagtcagtggaggagacgccattggaggatcaacccttacttgacattgttccaggacaataacacccaacggttccgaccatggatctctatttttgaagtagaacaagaggttccctctgaggcgacaccacctctctaagcttactttgctcacgaccccaacgcagctgagattgcgaagtcgtttttcatatttttgtctcttttcctttctttctgatttcctaaagaatccttcctgtcgttcacgtatgtacaaaatgccctctttttcaaacttggttgatggctgtgtagccaatgtcactagctcttgtttattgaatcgcatgattggaataggtcaagtagttcaatgtttcaagtattcacgtaataatcagtacttcacataaaatttttgttacactctttgttagatacatcctatggaagataataaattttagattacattttcgaaaaatttattttgaaagacacctaagtataaacgtcaac

SEQ ID NO: 709 - DNA, 1986 bp, Leptinotarsa decemlineata
  Annotation=Cytoplasmic protein NCK1; Tribolium gene name from OrthoDB database=TC013803; Blast E-value Tribolium Gene vs. Leptinotarsa Unigene=0
gttcacttatctttttttcgctagaagacagtagttccctagtctttttcgttcttctcattattgttatgtcggaaaataacatttgggatctgatcacatcgattaagtcaaatgatgcttcgtacaaaacatctatgagtgataaaagaatatgtccagtttgaaaattgtgctggagctccttatactattgtagactagagcatgtgtgtcagatagcactagttagttgtgcttgttgtcatgttggaaacaaggtccgttcgtggaatgccggaacactcttggaataactacggggcaaaaatttctcctcatcaaatggcgacccccatcagacatggcaaaagtggtcaagacgatgtctgttatgttgtggcaaaatacgattacgatcacttgggaccacaggagctggatctgaaaaagaatgaacggtatgttctactagacgacactaaacattggtggaaagtacagaattcacgtggacaagctggatacgtacccagcaactacgtgaaaaaggaaaaaccgtcccttttcgatagcatcaagaagaaggtgaagaaaggttccggatcgaaaacccttccatctaataactctccttcacgtacagtagaatctccaaatatggcgaggcgaatgcctgctgacccttcggaagccatcggcatagccatcgtgaaatataactatcaggctcaacaaccggatgagttgtcacttataaaaggatcgagaattctcattttggaaaaaagcaacgatggttggtggagagggcaaagcagcaatatatcaggttggtttccttcaaactatacacaagaggagggcgatatagatgacacgttgcatacttatgctatggcagagaacgttttagatatagtcgtcgcactgtactccttctcatcttccaatgaacaggagctgtcttttgagaaaggtgatcggttggaaatactcgacaggcctgccagtgatccggaatggtacaaagcgaggaattctcaagggcagattggtttggttccgaggaattacctgcaagaattgtccgattacatggaccgtccaatccaagaacggaacagacttcctccacctacaatggaaacttctatggaacgatctcagatttcgatggctgaaaaaccccatctgatcgatagaccttggtattatggtagcataactagatatgtgtgtgataatctgcttaatcagcatggacacgacggtgatttcctcataagagatagcgagactaatacgggcgactactcagtatccttgaaagctccaggaagaaacaaacatttccgtgtacacgtcgagggagctctatattgcatcggacaacgaaaattccacacgctcgatcaactcgtggatcattaccaaagggcaccgatctacaccaacaagcaaggtgaaaaactttatctggtacgtccccttccgaaaaccaaataacggataaatctaccattgaaagaactgtttaggattaaaaaagtactatttgtgtgagtgttttgttcttgaattttttgatgaatcaatattattattattcattggcaaacatgtatatctggtcatgttatatattttttgtttattttgtatatatgttttcgtctaagttattgaatttttagcagtaattcctacaaaagcacaaagttattttcgttcatgcaggatggtcccgttactgtttttacattttgtaaaaatattttcatagagccggaatcgaaagcgcggcacactttatgtttttgtgactagtcaaaagcttgtatttattagttcagtcgaaaggtaatgttggataaaaggaccaccctaacgcaaaacaaatagatggaagtgattcaatggatgaagctttatgtaactcatgaatactcaatattattattattataggaactgatgtcacataattatatttgttttatccta

SEQ ID NO: 710 - DNA, 3910 bp, Leptinotarsa decemlineata
  Annotation=Prickle-like protein 2; Tribolium gene name from OrthoDB database=TC015374; Blast E-value Tribolium Gene vs. Leptinotarsa Unigene=2E-87
taagctcattgaatatatttatcaaaataacaaatgtaaaaatatgttgtatgtagtataaaatatatatataaatacatatggcacaaaaataagctaatcttatagatgatatataatatatgtatataaataggcataaggtcaccacatgaagttaattctatacaataaatttatcaaagtctttcattaacacatagctctatataaattcaatacttcaattatcaaaagaaattgtttatattcagtctgatgaatacttaaaaaattcaaagaaaaagcaaaaacttgcaagttgatatcagtagatataatttgttatctatttcttatcatataatttgacactataatatactgtggcacttattttgattgtatcctatattggaaatacacttcaaaaatacacattataaataaaaagtcaacctttcaaaaccatacccaagctgccctttttgcaccctaacctactattgaataccctgtataatcagtcaaaatgagtaattatttttcagttccataacattcatgtgaacagtacaatttttcatttcgcaaaagcatcttctttttcatcaatggctttttgcaaactttacaagcaaaacattcatcattagcatgaaaatggacaccattcaaattacaaccaatttcatcaggtttaatgaccctgttacacgaactacatttacttgctttgctttgttcaaagcagggaaggcaatatggcatctcatcttccaaggtgtagtcttttccagcaagaggcgtatcacactcgatacagcaaaaatgcttcaagtggaatgtggaattctcagctaggcaatattctttagtgaatataagttcatcacatgccttacatcttggaaaacctctgatttttgcatagtcacgtaaacagtaaatgttatcagactctttgttatagaagtacacattgtcagcaatgatttggttacacccagcacatttgaaacatccagtatgaaacagtacattggctctttcaattgttatggcaaattctttttcttcaaagggtcttttacagtagtggcagtctggcaacttcatgttgttcaatatttccctgataatatcaggactatagtcttcataaaaatcattcgttccctgggtagctgcctttatttcaggataactgatgtcttgaatgagtccaacattcacttgactaggatgaagaaactcttcatcgactatcaaactaccgggatgcatttcaggcaaatttttacctaattgtttcaaattgttcaaagcctgtttgtcaaaagtatcagaattataatcatctaatggtttcctcaaacctccagaagaggatacatttctcaaatcttcatcactaggtaaggccatatttgaataactgtttttattgtcataattattttcagagtttgggttttgattctgtaccagattatcaactggttcattttgatatctcatctgctgctcaggtaaatgttggttgataggcctttcagcatttctccaatttgcttgaattggtctgaagccactggagtttttgggtgtttctcccctagagaaactattttcgttctcagggtaggaaccaggttttctgtaatggccaaatttaaattcactttcagtatctcctaaatcatttgaactggcattacttggatcgtgggtgctgaaagctaggtctctgaaattcttaggaatatttgatggggactgaacatcagaatgattactataacggcctggcgcatagtttggtaatctgggagccatatttttcatattatgagtattttcataattttctttagctccaacactttctgtgttgccttgggcaaacttttgtaatacttccttatttggtattatgttagaagtattcttatttccaatttggtcattaattctatactttctccccaaagattcatcatatggaacatcattatcaagtgtaccttttccttgtccaaaggaacgggggtcttgagaccatttacctactgcagaatcaacagatttttgatacctatattccggtgaagcaattttggagtagttctgctcaagagggtctacattttccaaagactgatggtaaccgcattttctttctgatttgaattggatttttgggaagcctgacctggtaaactaccagtttttccaaacttaaattcaggtaaaacacttttgggatagtttgatgttagtggattaacttcaccagagaacaaattattttctttacggatatgatttgcactttgtggactcctaccaactgtagaactgccactttctttatacttgagtgccggtgaactagttatagcataatttggatctacagcatccaaattttctctggactcatctccggtttctaatccactggacacatttcctcgcagaactggaaaattacttgagtaggaaggatccatagaagaaatactctgcacataactttctccaggtttcatagtggtagatgttttctggtaagggacaaaggcactgcttcctgagtcaaaaatacccgagttgtcttcagaaagaacattttgtcctggctgaggtaaattataaggcacattttgagctaggaactgactgggtctatttttaaaatcaaaattatttttctggagatacttgggatcaattgaaggatcgattacagattggttatctccactccccttatttctttgaggaacaagaccaccagaaaactgggcactagagagtcgagaaattgtgtcattactgtaacttgggtagtttttgtcattaaatttattcggcactaaaggatcaaggttatattcggtttggttcaaggtattaggaacaaatttcggaagatttttgtcattcatgttgagtttttctggttggttcaaaatatcatcaggagcaaaataaggaagacttttgtcactcaaagtaatattttccaagttcttgattaattcttgtggtttaagtgaaagggccttgctttgcgactgtaatttaacaatttctgataagggtatacctttagcatagcgactggccatcatagctgactctgcaggattcaacatatgtaggttacctttaattatacttgataaactaactatctggcccacacctgcactactttccttaacgtgtgctatatattcattcattttcttcaattcttcttcagtaagatcatgacaaagggatggatcaatatcatgaataggaatttgtttctggaggagttgctttctatcttgagctgcttgggaacctttaactggcaattgttcggtagacaaagtcttaagatatttatcaacagtatcattatggcctttgggagcccaatccaaatccaattcatcttttttaccaggcagcaaaatttttttcctgattttatttggtttactgccaaccagttgaaactgtgcccatccataaatatcatcatcttgaacttcgtgttcttcctttggacatttacaaagcttgcaacattttctccaaaaatgaaggtccaagcctgggcatttttcagcacattttaggcaaggtgcacctgctcctgcttcatgtcccaactttgctttcaaccttctttcccttttagcttccaactcctgcagccaatttggagtttctggaacaacaatttccccgctcatttcaaggcttcaactaccattaacttcaaaaggcaacgcctaaatatttcgtttattatgaacaggtagttaatttgctgatgacaaatatctcatgaaatgagatgagtcataataaaaacacattgttttgatggttcaacttgtgagttgtgttgtaattagaattgtgt

SEQ ID NO: 711 - DNA, 797 bp, Leptinotarsa decemlineata
  Annotation=Gamma-aminobutyric acid receptor associated protein; Tribolium gene name from OrthoDB database=TC030688; Blast E- value Tribolium Gene vs. Leptinotarsa Unigene=1E-78
agatataacatactccagaaagtttgtgaaggtaattatttatttttaaccaatttcattcttagatcacatgaactaacacctactagtttcattatccaatatgtttttttgatttaacctacctaacctatttgttaacacactcaaaataatatgtgcacttatatcataataacccaattcaagtcagagccctttaataaaaactagatactttcaatcaagaaatacttgacaatatctccaaattatacatttaaatatttaaaataaccaatcatttatatgaaccgaaatttgatacattgaagttaattgaaaagaaaattactcttcggaaccatatacgttttcatcagagtatgctatatacaggaagaaatcctcttcgtgatgctcctgatacagagaacccatagttgcagatgtaggtggaattacattattcacaaaaaagaataatgcgtcttcaggcctcaaatgaatcctttttctgataagaaaataaaactgtccaactgtcaaatcagatggtaccaagtattttttcttgtcaacatcaccaatccttgctttcggtgctttctcaacaattactggtaccctgtcaggatacttccttcttattttttctccttccagtttccttttttcaaatggatgttcttctttgtagagaaacttcattgtaattcgcactaaaatttaattgttttgattgctcaagaacgtaatatacgtactttttctttcgcaaagttgatgtcagttgctgatcgatgcgacgtttgggt

SEQ ID NO: 712 - DNA, 2884 bp, Leptinotarsa decemlineata
  Annotation=WW domain-containing adapter protein with coiled- coil; Tribolium gene name from OrthoDB database=TC002983; Blast E-value Tribolium Gene vs. Leptinotarsa Unigene=6E-141
gattaaaaagttttaatgaactcattttggaacatttcaatttttgtaagattatatataacagacatacactcaattacatggagacaactatacaagtatttcctcagccaaaattgaacagtgctaattaataggcatgaatcctgtgagatttgttttcgcgtatcgcataaaatagaggctttccaatttcctttcaaaaacggaattaaaaataaattacactatgtaaagccatcgtataaaacgtttcgttgccacgtccaaatctcatcaaaataaaaaataaagtattggtctaatattaaattgactgaagatttgaacatggcaaaagaactattgagaaaacaaagcaacgaacagaaacaatcaacagggtttatatcacaagatattttgtaatttctatatatttcaagaaattccggagcaacaacacccactttttgccccagtgtatattttcatttgacagattgaatacacttcaaaacgttaccaaaagcaacgtccttttgttcattttgtatataatttaaaaaccatatgaattaacaattttcaataaatattaaataacacaagttgctgcaaagaaaaatatatttaacatttaaaaaaattacagtgacaaaaattataattaatttataaaaatattacctaacaattacttgtagtattcaaatacattttataaattacaaaaataacaaatgaaaatatacacaatagaaaacctatggtctatgttatattaatttatctaaatctaaaacataaaaccaatataatacaaatacaaggtcgtataactctagctaggctatagtctttagtatctattaaataaaatgccagattggcccaactagtaggactcgaaggaaatatgaaaatgtaaatatacaaggatcaatataaatagactaaaaaaagtttatcgcagattccaccgaagatgaattgttgaccataagaacacactaatcttgtgatatctgaccactaagaatcatcggacatgaatgaattttgtgatttcaactcttctaattcctttatttgctgacgtaaaaataatattctctgttcttgtagggttgcttgaatttcagtcagacgaactattgacctcgctgatttaagttctgctgaaactttggaacactgtatactgcccattatatgagcttcatctgctaatttctgagcctgtttttctataatttcagcaggccaacccctgacatgattcaccagatcgtccctataatgatttgctaaagaaggtgttatcgttggcccctgtggtcgtaaggcttgtaaagaactagaaacaccctgaagagtttgtaaacttcctggaggactactagcaggtactgccacagcctttgcacaatccggagtttccgaatgagtaggtgtaggggggccttccacaatgattccagagtgattagtgtccacactaagagaaatatgcactgcactttctccagacctttggaggggttgtgagtttttatccgcattatcgatcggcgttgaagtttgtgacattaatctcggtaacgaagataacacacttggaggtccgggcgtattagaagttgtaatggtcgacgacggcacaggcataaccgagggggtactctgaggggaaacatccgtcctcactaagggcgtcgagggcacgtgaatcggatgcgacgttaacttcggcaatgcattcgccagtaatacaggtcccattgtattctgttcagttgttgattgtgacgtattgttaccatacgacacctctgacgtaggcgtactgtccccaggagaaatgtccatgtcttgtgttgtttgtacattttcttcagaatgttttcgggatagccgcaattcctttgaggtaacgtcaccatcatccctgctactgccactgctccagtgacggctgcctgttgcactatcccgcatgtgatccttgctgctgctgctgctgctatttgccgctctcgagttggaatgtttctcgtgtctcataacagagcggcttgagctactatagtttcggtctgaatccctgtctctgtctctgcttctgaagcgatctcgttccctctcccgttctatccattctctgggcttctcccactgagatacttctgttttacaattataataatacttcttgccagacgagctaacatgttctgaccaatcacccactctaacaaccctatctctatcttctctcttatctacacagttattatgcatcggttttctgtctctagaagaaatctgagatgattttatcggatgcaaaatgttcttttcatcaattctatcggaactaactttgtgttcagaatctcgactgcgtttgtcctttggtgacctggcacaatctgaatacttgtccctggacattttatagtctctgttttctctctccttttcacggattttctgtatataggagttcttcgattgatatgatctttcacgatccataggtgattgcgaatctgggctgtccgatcgataatttccattgggggaatcacggattctctcgtacctgtcactgctggatccataactttttgacgaactgtacttcgaactctgataaggatgggcttggtgcttctcgaagtacccatcgttcatccgctgagttttccttgcatgcattaccatcaatgcacgtctctagaaaatgtttgtggcttttacaataagccgccccgtcaaatgatgtcataaaaacaataataacgtctgaactctatcaaaaactaacttttctatcagacgccatgtcacataagggaataatttgcagctccaaaggcaaaatgctctttaagtatcc

SEQ ID NO: 713 - DNA, 768 bp, Leptinotarsa decemlineata
  Annotation=3'-5' exoribonuclease CSL4-like protein; Tribolium gene name from OrthoDB database=TC015397; Blast E-value Tribolium Gene vs. Leptinotarsa Unigene=1E-1; Blast E-value Tribolium Gene vs. Leptinotarsa Unigene=01
tgatattgaccgccataaattattctgagccttaataagaggtaggaaactattttttaaacttcttggtaaaaatggatcaaagtatatttaagtatcaacatttctttctgaattttctgaattcacattctcaggtacaactttcgctacttttctacattctttaacaaatgttttggtacattgcatctctgtccaacttatgggtaccatgggatgtccatgttctgaatgtgctataactacacctaattcattctctgcagttgaaagttgatatgtgtgggcttccgtaatgggtaacactcttgccaatattatatcgcctggtctgaaactcttatagatttcaactctatccttctcagttgctctaacatcttccctccgaaccaaggctctgaatggcctcctcagcaatgtgtcaccaacgcctttaatgtggcatttggcaaattgttgggttatgatgtacacttgtgccgttactatgtcaccttgtgcaggaaccacggtttgttctccactactgtggacctccactatttttacaccatctttttggataatgtctacagaacctgccagttgtgaataaatgtacccttgcctttcataagtgccttgcccagaagtgtatacttgatcacttaaacagagtctctgacctggaaggcaaataagaggttctgatgtcatgcttgaaatttaaataagaaaactgtcagtggatccgatgaatatacatatttgttccaatttttc

SEQ ID NO: 714 - DNA, 4177 bp, Leptinotarsa decemlineata
  Annotation=Peroxidasin; Tribolium gene name from OrthoDB database=TC001556; Blast E-value Tribolium Gene vs. Leptinotarsa Unigene=0
tgtcccaaggcagaccttttagacttgacattcaaaaaaaaattaaaatcgatttacaacctcacattttaggggggtgcttccatcaaaaatgggtcacactgtattacattaatgttttatatacacaatcgatagctttcaacgagagctgacgattaaaacttgaacgaatcaaatgcatcagaaagtaaacatatattcaacaccgttgagtaaaaaagatataaaaaccgtatttttgctttgaaatttcttttttgttccatgaagatattgtaaaactttcaccagttgttcctttcacctccaccgacgcaaaagtagctgacgtttagagtttaaaaaaattgaggggaaactatcattggtatgattatcaatatgtatgaaattacttattcaaatgcaagctacctcccggactgaaatatacaatttactgtaatgacaataagttatttaaatctgtttgactatattttctattcattttgtctcataatcctcctatacttttttctagattgttgtttaattgtctgaaatctctttccaagcctgtgacgcgaattttcaaagtatcgatttcgggtattgcattcttcgagttgaaaaagcagttccttctttattgatatgtctcctgaacctcgaattcgacagacaggttggttctcgctcccctggataccggcagtcggtgaaacattcgtaccaaggcctgaggtcaacgtgtggtattacatcgcaatccacgtaaccgccttgtaattcaggaagtctgaaaacgtccgatgtgattctagtaatgttgtcgccgttgtcgcagagaactctggacagagaatattgttttatttgcgccagctgctccggtttgaacactgatggattctcgtagtagaagcgatctccgtctcgcaaccttttgaactgttcgatgagcaggcattggaaaagaggtcctacctttccgccatcaacttgatcttccaaaatgcctccaacaaaaacatcgatgtttccaggatgcccatatagttccttaagtttcctcctcacattcgaatcgctaatctcgtacttcagatcatcaaaagtttcagccggtgtcatattacaaaagcgacgatactctgtataacccggcagggcatgatcccttcctcggtggatattcatagctgccagatccaaagctacggcgtgggctaccttgaagagagtttccgtgagttccgtattgagattttcatcgggtttcttgattttggctgctactgtgtaaagccctctcaacaatggatcgatccctccttcttcgacgagtctccaaggagagaagaatgccttcgaaagtggcaaattgccttctcggatgggtttgaagtcccagtcaagtctgtgtagaactgggttgataagggtgtgtccgaaacgaagcgcagccgttgcgaatacgttggatattgtgggattgaggttcgggttatatcctctatactctcctaaaatctccatgcccctttgtcctaagataatgggtagccagagtttgaaagttaggtgttgcatcgctgcaccgacaattttcctggattcgtggtaaagtttgtcggattcccagtgcgggttcatcagtttgagttctctcgctattctgttatgttcccgcatccacagggtgtgcatggctaagagacctacctgctcgtttgctcggatatcaccagcaacaaagcagttcagaatgctctcggtaagatttcgtctacagtcaactccctgttgttcagcataaggtaaaagtggttttcgccctgaaaaaattggaccttccctcagtctacccccatcagtagtgagatctctgagattcttagctagttcctctgaaaacccgtatacctgcgaggcatcgatataagaagtaagttgattaatctgttccctgtgttggatcgagtcgaagaaaatcgaagtcattcctgatccgcaaacagacgacgatctaataaaatctatgcacctcctgtttgtcacacgggggtcgtttggagggacgtccatggggtaacatggggcggcgtagtcgcacgatttcttgcagtcgataccatcccaactctctgaggtgactgatggggtggcatggtccaggtcgtgatcaagaaattggccccattgcatgaccatgtgggttatttctgggtctggagtgattttcgacgtggaaattaacgtagtggataccaatcttgagctgggcttggtaaatccataatactttcttcctttgatccacccgattggctttgtaagaccgtcttcataaataggtttgagaatacgtctgaaaccgctggaagaagccccccacatgggatgctgcagattgttgcaggtaccatctatggaacgatatttggagtggaagcacatgtctgagcaatttttgaggagcctgtgtgtcatgcaacctgataaccttgcgatgaggtccaaatgctcggcagacaaaatttgtttataatcaaaatcttcagttgaattcatgatcatgttttcttgttcgacatgttttctgatattagtcagggttctttcataaacttcagcggctctagctagctctcttgcaggagcatcgggatatcttatgattctgaaaatttcggctggattgtgtggttttttgttgttgattatgttgtcgatcgttctgttgatggcgcggtcaacttctcctgttgcttctgtgaaggctattttcacgaatcggtcaccaattcctatccctgtaggactctgaatatttttcaccgtgagatatcctgctgcagaatctcttccatagtcattcagagcggtacactcgtatctgccttgatcttcgggtcccactttataaatatacaaatttccgttgtgggttactttgaacctgccggtcctctgcatgctggacccgtccttttgccaagtgatgccaggcctagggtctccagtagctctgcagggcaattctatagtacttcctacaaggcttcgacattatacggtttgtaaactaacttcgctggttttctggatacattctccacgttgattctggcactaacttctcttatacctacgtcgttcctggcctcgcagacgtatagcgaactgtccgtttcttgtgcgtttttgatttggaggaaagtattatcttcgcttatgaacaccctctcatctcgctggatctcttcgtcgtttttgtaccaaattatctctggggttggggtgccggatgccacgcattctagtctgattacaccacctatttgtatgttgaggttctctggctggattgtgaaaatgggagcggctttgatgattagattgccttctgctgctattctaccatactgattgatcgcttcacatagatagctaccatgatcgagagggttgatatcccttatcacgagtccatctacctcataaaaatatttctcagacgaaggaagttgtactccatttttggcccactttatcaacggtattggatttcctacaacccgacagtgtagcttgacttcagcctcaccagatgttgaataaactgtttctggttttctcctgaactctggtggcccttgagcatgtgctatggccgggccgtccgatttcaaaacagtcattttggctggtttggacttaacttctccgttagtattttttgcaacacactcataaaatcccccgtcgttttcatctgcgttgtgtataaggagagaaccttgttcatcgatgatatacttgttttgttctggtatcacttcctgatggtctcgcatccagtagaccgttgcagaactatcctgaactctacatgtgaatgatgcagtttgaccccaagaaacttcgacatcacgcgggccttccataatctccaaggacttgcagtggaaatcatccaacttcatgcccttcagagattttccgctcatctcatgggggtacttgcaatttgcagatgcttccaaagagttgtcagtcagcatgttggctaaccacagaatttcgcagtcgcataccaacgaattgtgatctaatctcaatctttctaaccgtggaaggttttggaaagcgccttctggaacacgcttcaattggttgtgatgtagat

SEQ ID NO: 715 - DNA, 927 bp, Leptinotarsa decemlineata
  Annotation=Mitochondrial ribosomal protein S2; Tribolium gene name from OrthoDB database=TC002780; Blast E-value Tribolium Gene vs. Leptinotarsa Unigene=4E-95
tttttttttttttttttttgtttaaacaagtataattaatgatattctacacatacaaagtatctatcttccaaaatgttcttttcgtttttctttccctctcaaaatagcacttttgaataatctacaataaagttcaattgcagctggggtatcatcatttcctggtacaggataagttagcaaattcggattgcaatttgaatccacaatgcctatggttgcaatggccattttagcagcatctcttatggcctgtatgctgaatgagaacattattcaatgtattgagaaaaatacataaatcaggtagtcttgtaactgctccaaactgcttatcgacgttggtgaaaattccgcccctccagaatctcgtgtgtgcatattcttcacattctttagctgtagtttcaaccagatgtgaattttgtgcacctctaagaaaaaaagttattatacctccccgataagcaacatgagcagcgacattgagagcttgtcttagatattctgcagtaatgtctaggtcaaatattatatggccaagtctgcttccgtagatatatggaagcattctttcatccaaagatccttctttgtgaccatagtgtactctagcatcaagcaaatccttcactgtgaatagattgtgcacactgaagtagtctgggtgctgtaatgggtcatcttttcttgtttccttttcaagtacatttgattgttgtggttgaaagagagtagataatcttcttatgccattgtagggtgccgtaactagccttttcaacatgattaatgaaattttgtggtgaacttagatttggattaagaattgtactgaatatatcatttcatcatcaaaagccacaaatcttcacactacacaatcatttatggttagataggttataaattctacataacccc

SEQ ID NO: 716 - DNA, 1954 bp, Leptinotarsa decemlineata
  Annotation=Cell death activator CIDE-B; Tribolium gene name from OrthoDB database=TC011893; Blast E-value Tribolium Gene vs. Leptinotarsa Unigene=3E-16
caaagagacagcttttagacacaaactgaaagaaagtcctcctgaaacagctactttcatattaacattgaattggtaatagttgtttcatacattaaactttcacttttacttcaagaaagaaaataaatggaagcattcataaatcacacttcaaaagtgtataaagctactgtttattcaaatggtgaaaaatttcttgaagtgagaaaatgaataaaatttggtatattaatcaacaaagttcaagtttgaaatttgaaaaacagttttaatttttttcaaccagaactattatttccattgcaaatgttgataactcattggttttcatgcttgaaattgactattactcctaaattattttttcatgtttaatagttaagcattgttcatatgcaagattttcacaagtgatttttgaaagatcataaatgtacttatctttatataagttgaaataaaattactcattcattaatttagaaataaacaagtgtattaataaaaggtccaaaactttttcgaacaaaattttcaattatatccaatatccatttgtgtaggtatactggagctctatatttgctaataattctttgtgtgaaaattataatcaaaatggcctcagatatataaaaaatgggatgtatcataagcagtatttgacaatatgtcaaatttatgtcactgatagaattccaatgaggcattctttgaggcaattttttcaagtctgaataaccaatacttcatttatcgaaaataaagagcattctgaaaattcacatattcatcaagctttattcaggtgatcatcgctggaactctgcaagcagtactgacaaacaagcaacaatgtattccttagaatgtagaatgcattctaactcatctccttaatcctcttcatttattgctgacagagttcctctactaggttaaaaatggtaaatacttatagtgctacaattattcatcactgaatactaatacaatttttgttttttgatgttcatttcttggatgtgtgtttgtgacttgagcaaagaattagtgtcatttttcccacgtattgacaaatcagtcttattcttgtgtatatgctggtgaaaattatgcagctgtcacattttaggtaaggggttccattaatgatatctaataaaatggtttctacatttccctattttccaccttcagtctcattttctttctcgttgtatactcgcaacaaatccaaagcatcttgtgcctggcgcttatcagccaaatatcttcctgaaacctctttgagctggtcgagaaatattctatctggaaatgttatatcaaccaaggattctgggtccatatcactgagcaattcaagatcagcacctccaagtaaagacacatgacacatattatgcttcagcttaccaacaaggttaacaaggtctctctcccctttgttgtccacatcgtctatattgagacgtaagggtggagatttcggaaaccaattctgaccctcagtcaacaccattagacaggtgttgggatccagagtaccaaagtactcttcgtcatctatctcagtaccatcatcctcaagaacaagagtaatattgtccttgtctgaaagattcagtttttccaatactttcgaagacaaatcttgcaaagacgaagccactacgcctttttttatttctctagaagctgttgttatcttgaaaggttttccagtttgaccatcatcctcttccataatttttatctttcaatttcatctgatatatgttcaatcaatctctatcgcaagaacttcgcgtcagagaatttcactactcaaaacaatcacaattcataaaacttcacgccacgaagtttacgccctcaaaagtcgtaaacttgaatttttgcaacttgcagcctacaaatgatccaatgaatgaatgcactctttctc

SEQ ID NO: 717 - DNA, 1408 bp, Leptinotarsa decemlineata
  Annotation=Coatomer subunit epsilon; Tribolium gene name from OrthoDB database=TC001210; Blast E-value Tribolium Gene vs. Leptinotarsa Unigene=4E-155
tataaaacgaacctacatacaaaatttcagcctccgaaaatatagtggtacgtaaaaacagtgatgaaaaggtaattttcatatgtaaaccctcaccttttaaccccaaggagagcgccccggttggaagcacatatatatcaaattttaggcacttaccagtacaagattgttatcagtgaatgtgaaatcattcacaagacctaaattttcattaaaaaaattacctatgatgtcaccctgtcaaatcctatgatataacttcatcgtatgcttcgaaatattacacatgaaagtttatggtttgcataaagatatatagatttatttaaatgaacttttttttaataaaattataatggtgtactagggttggaaacggaatactgctgacaaattcgagaaaaatcagtttctttctgcttcaggtccttgataaaggcatgatctgggttggcatctttcagttgagataagaatctgttggcaatctcgggtgtttttcccatatgcctctgaagaacaatcatattcactaaagtgtcaggatagttagcatctttatccagagcctcctgcaaagccgcttctgcttcctcatatttagcctgaccaataaaagtaactgcctgaccattgagtaatagtggtgttgatccatatttatcaataagctcctgataaatatagtaagcatcttgtagtttgtcacctcctgaagcaacattgatccatgcttgagccagctgcgtcaaagtagcatcatcatctttatcttgcatttcctttaactttttccttgccaaatcaacacgatctagtttcaataatatatcaataataaatgctagtgactcgaggttgtctgatgcatgcaatgttctatatgcagattccagattattttcgttaacgtaaatcgtggctgctaccagaatgagagtttcactattggcgtttgccgagatttcctgatcaatctgggctacaactgcatctttattagatttgcctgataggtactctgctaaaagtttcagtggttgaatttccagaggagaagctccgtgaatttcttccagtgcaactagaaatttattttgggccatgtaagacctgtatgtgaatatatctctctgaatggcaacttctgcagttgatggctttcttagtttctgagcctcgtttatacattgttgataattcccaatataaaagaaattttttacttcgaaaagttcatctacgtcctgttgttgacgtgccattttttgataactggatatcaggatagccacccttgccacatgacatttattttcgtactaaaaatgtgttgcaaaatggtgtttttgcttttgtcacgatatttaatctgtgtttttgttatgtcaaaaaatctcaacgc

SEQ ID NO: 718 - DNA, 2291 bp, Leptinotarsa decemlineata
  Annotation=E3 ubiquitin-protein ligase UBR3; Tribolium gene name from OrthoDB database=TC005948; Blast E-value Tribolium Gene vs. Leptinotarsa Unigene=0
ggtaattcaaaaaggtatctgaaggtatcctagttgagacagacctgtagtaagtaaagatcagcgtcgaccatggagttgcagaagttgcactgaatataggtcatagcttggcccttgatctgcagaccatttctcagccacattccgttcaagatctcgtagaaggctacctgtactcgaagaggatgcatcataacgaggttcagaaacgagtcgttaggtggcagcacctcattcaatttgattccctgcttagatacggcttgaccaaggaagactgcaagaaatctatgaagcggcagatgaaaagacagttgaagactatcatccacagaaggatttgtatatgcaatagactcgaaccagtccctcagttccttgatacaaagggataacacccttctagttaaagcggctgtccaggaatctgtcagatgagaaacgagagcccacataggataggcactcgcctctagttctgcactgaaagctgcatagtaagtgttgggctcaaattcaatatgcgcagccacttctttctggttcacgttcataccttgaaacatggagagaaatgaaaaccacatttctagcagaccatcatcagacataaacttcaaggcaactggtctatgagacagaacattattcagatccgataccaagggccaatagcaatggtttttcatgacagtttttgcacagtcaacaacccagtggcaattttcttctacgtcatgtatcgtactccttatgagtatcttactcatcatgtacttcaaactaactaccataacgtgcaaaagattcaactgttccgtcatccttgttgccaggttttcgttcgagaacagctgtacactgacatgcaccactcggttgctcaacgtgtccggatctgaagatctctccaacatcatggatatgcgactatagtgaaggacaaacgctctagtcagagcttctttgtaatcaggatctggaagcatgttcaatacgaggcaaacaatcctttggggaaattcatattttacggtccagaacacaagctcttccagaaaagttttgtgaactaacgattcctgaaaattgtagtactcttggtattcttctaggggctctgtattttggagggattctaaggctctttcgtaggcaagccttgattctatcaaatattggtcatactccgactcggggttctcaggtacttgatttaacattctgtatttctgaggattagtcaaagcagacgttattactcgtctcatcaaacctcccatattattgaaatccactaccatagtgatatagttctcagcatcttgtatagccttcctttgagtatcgtggatatccaaccctcgaatatctgatccgctgttttctcgaagatgttgtatcaaacgttgtataattctgggcatcatggcttctgcaacgcacattaggtcagttggcgctttccctttactggagctcttttttggaccatgtttgtcgcaaaaacctgcttctttcatgaccgaagtatctccacaatcgcaagctccacccgcctgactgaggaacatattgaaatcgtgccttacgtggtttccacttttgaaacagtccgtgcacagggacatgcacggagatatgccacatgtgcggcatctgtaagctacgaaattcggagtccatactaatccacaagtagttgcgttatcatatgccaaaactgtactggcaaattcatcaggggttcttcctcctgccattagccatttgcaccagtctatggtctcccattcgtctatagctttatgggggttcagaagattgtccaggacttctttcagatgttgtggattccgtttattggagcagtcagcatgaatatatgcggcggtggcccgtttacctttggacatcaacacttttacctcaaatcttgatgttgaggccattgtaacggtctaaaatgtcatgtcatgtgagaatttcactgaaaatctttcaaaatgacgtactaaaaaacttcgatattacttcacatccacaacacgctggatcactgcaactttacaacaaagctttcacataaaatgtggaaaatatatgaaatgtcacaaaattaatgaataacttgaaaactaatcgttcattttcaatcactttatacaattatttactaaaaaaactatgaaactcagccaaaatatcaaaagaaaaaaccatacacatattctacacaaacgaagacaatctatccttttctcaagatgaaacctctaaactcactc

SEQ ID NO: 719 - DNA, 3360 bp, Leptinotarsa decemlineata
  Annotation=TBC1 domain family member 25; Tribolium gene name from OrthoDB database=TC014792; Blast E-value Tribolium Gene vs. Leptinotarsa Unigene=0
aacgtctagtagtacttttttttttttttttttttgtttaggtaaatgttttattaaatgaaataaacacttttctccttaccagcaaaagaaaactcactcaaattattactagtgtacaaaaagaaatatttacaaatgaaataaaaaagtaatacggaataaatatcacagtactgaataataaaaggaaacaaaccattaacattcttcaattttggactctgttctttgctgagccatactttgttgcttaatatacctagcgtacatttgccttgcctgattcaaaaccctagttacattatgttttctaaccattttatcaaaatgcattgccatctcattatagtccatagctttactgattatgtgatctcggtgctgtaaaagcaacgttatacaaaggaacatcaaaaatggattcccccctccaaattcatttggtgggggaagaagagacgttgatttgatagattcagtaacttcttcacaggagtttgtcatggttggtgttgttccattcatcatgatatgatttgagaaaggaccatgattcggaacatcagagttgcgctctggttcatcctgaactgaacacaccttttctataggagtttggtttataatttttattggagtgattgttttcatggctgacgtctcatttaccatgcttggggcgtcattctcgatttcaatctgtttgtctgaaatgtgtgtggtaattttaaccacattattgggacttgtcaaatggagaggattttcccataaaaaaatatcatcgcttcttcgttttgtttcaaaattttccctaacatcaaagtcttcggttactgtttttagttcagtatttccatcttcactacttggaggtgattcacataacctctctatgtatttatctccgaaaactgttctgtccaaattctcgagttctagtctcaattctctggtaaccgaagtagtcaagggaaaatattcttgggaatcatcgggactagtttcatcaaacgtttcgtcattggaagttgaggaataatgtctagtattttccgaagtatgatccaagctggagctctcagagtcatcaaagcttgatttagtaagcattatcttcggtttctcaattgcagcttcaatatttacatctgatatcttattcttgctaacagtaccaattctcaggaactcgttgaggttttttaccaacttagtttttggtgcacgctcttcttcttcctttattgactggttggcatccaacttatctaaagaagaaaatagtttagcagtagttattttgtcattgagctctttgaaatggcccggtcgcttggtatttttaattaggttagtcatgctggaagataagcttgcacttttttttgttagaaattgttgagtattaagtctattgttcagtactatggagtctgatttttgttctaaaggggaaacagatcgggatctaagctcagatttgggcgaagttgacaaaaactcgaaattttttgagtagtaggaaaagtcgctacactttttcggggatttggggctgatatcaatacttttagttttgctatgggttagtgcggtatcatccaaactttggtgttttatttttatgtcagtaatgttatgactacacctactaattgactcatctaggctgtgattctgtctctttacttgattgtttttcttacagttataattgctcaatgatatggaagaactttgccttcttaaggcgcatatttttgtgtactgagtttccctcgttgttttcaccaaaggactaatgggtggtgttgatactgaaggtagttgaaacaaggtatcaaagagcttcaattctttctcaggagggtcagcaggtagagagctccaaagaacttctaacatacgaagagaatcctcaaaagcaaattctctcttcatttctagaagtaaccatcgatagcagaaaagtagatcatcagcctggtgaattttcaaatagttatgaaattcttgatcataatacatgattccttctgctaagtggctgaatttttgagtcatagcaattccatctatcataaaatttgtgcatagcctctgcataagtgcgcagaagcaaatataggcatgagcctcatcgttcattgtgacaagaagtggggaagcaaggtcactcattccttggcaataactaacttttggatgatttagtgcatatgtggtcaatatattgaaaagtgatgcaatattttgattatcatcacttcctgcataaaatggatgatgacggtcagttctcaatacatcttttcggaccattccggttgtgtaagctaattcacctacaacagggccttgagcaatagcagttttccatgtttctctcaaggtaacatactccagtgcttttttcttaatgtagtccattctttctttgcccgtcataccttctggataaacattcagtagatgtttccacacaacttttcttagacttggatcaattcctccaaagtaaataactgatcttaattctttagcatatacaatctgacccactgcatctaaaaaccttctaaattctgcatcagataggggaggccttggaggttggaaaggagtttcatcctcaccgaaattgaatgctctctgtaccatgttcaaagtttttcccatctgattgaaaattccatgcaatctaggtgatggcttagcttcttgactagtagctgttcttatttgagtcaagattggtacattctgtttgatttcccagtcgtcagaacattcttcaaaaggtcttaaatcgacgcgcaaacataaacatgcttcactattggtagctactgatgtattatgtgctttcaaaaatgcagcatctaaatcccaatcagaaagtaagggcatataggtttcatgcccattaacatcatacactctgaaacatattgtaaactctcctttgaggtcaaaagctttagctaaaatgctctgaagtacttcaaaagaagttatttgtgggtctacactgaattttcgccattctggctgttggttaccttcacatttttttgactttcactcttaccgcttcacggctgtaaccaaaaacacccgacatacttaaaatcaaataaactcaagaaattgatgtccacttgttaaatttttatcatactaattattggaaagtgcaccttctgcaccatattcccagaacagtccggcgataaattgtaattttctttcatattttccttccacaaaaactgcagatattatgaaaattgacacaattacctttcatcttttataacatttcaaaaacaaaagccaaaaatatcacaattc

SEQ ID NO: 720 - DNA, 940 bp, Leptinotarsa decemlineata
  Annotation=Protein FAM173B; Tribolium gene name from OrthoDB database=TC030548; Blast E-value Tribolium Gene vs. Leptinotarsa Unigene=1E-42
ggtgtaactatgtcctagaatgaatcgagctggctaaatgcgcctatagggaagcaaaggccaagaactttgagtgaagtgaagtatgtcctagaatcgtccaaactgttaatccgaataaagatattgaatttatgaataataacttccctgaagaaaatacattttcgttttcatagacaatattcttattcagttctacatgaattcttcagaatttttcaacgccctcaatagatctgagattaatgaacataaaaaaagtatcttcatttggaagacttctagtaggaatcacaggtggaatagcttttggtgtaaccgtaatttgtattccttttataactccagcactgcgtaaagtttgtttaccatatgtacctgctacaaacaaccaaataaaaaatatacttttggcacttgaaggccgttctggtacattgcttgatctgggctctggtgatggtagagtcgttttaggtataatttgagactgctaagaacaaatttgtatcacatggagtagaattgaatcattggttggtttattattcaaaattgagtgcattgaaaaatggactagccagctgcactaagttttaccagagagatttatggaaatacaatatatctgcctatgataatattgttatttttggtgttgaacaaatgatgaacgacttagagaaaaaattccagagcgagtgtaaagaaaattgttacattattgcttgtcgttttccattaccaaattggacccccatcaggaccttaggacatggaattgacaaagtatggatctatgaccgtaaaaagttttgacaattcattgggaattggagaattattcctatcagattttgttaaatatattttcaatgatttacaaaattagtttgtggaaatagatgaactgaactttttcaatatatcacggaaa

SEQ ID NO: 721 - DNA, 4814 bp, Leptinotarsa decemlineata
  Annotation=Protein WWC3; Tribolium gene name from OrthoDB database=TC008094; Blast E-value Tribolium Gene vs. Leptinotarsa Unigene=6E-166
accataaccttagagatttttaggtaccttttggatggctctgaattctatatacaaaaattttgagaatggccagtcactacacaaacaaaaattaaaactatagtcatcaattagttttttatgaaacggtgcattccccagtccgaaatgcaccactaaatcttaggtgtaaaaataatccctcttaattcgcctaaacgactggcttataactctaagcgagagcattcctataatataaaaaagggcgtttaaaaaaaattgtcacgtcttagtttcaaccacccagttcaagagcgagaaaggataaaaagcgcgaggataactttaaaccttattttaaaaaagatatggtaacagagttgaaaaccattgtactaaataatatgtatcaaaaatgatatacacaaaaaaagatgaacaaagctgttcaacgttttcgcaatattaagaagaaactgaagagccacagaatattttcttcaataatcgacagttcaaattttggataagaacattcaaattgtcaattattcatcactaacagttcaatccgtcgattaatctcgattaatgtttcgaaatgacatttatggctgattggcaattcaacacttcaaggtgctgattttagtgaatgacagttcaactgtcaactatctatgagtgacagttcaatttgaccattaactataatcaacagttcaaactgatttttatcgctaatcaactgttcaaactgtcgattaaagctaattgattatttaatatgtcaagagtgattaattgagaatcaactattgaaaaactgtcagttataaaaaatactcgatgacctttcaatgccttcatacaatataaacatatatgataaattttctgagtataaataatcatatggtcagaagtttctgaaggcactacatcacagagtttgaatgataaaatgtatataaataggcaatatgtaaatatactaagtcaaaaatgaaacaaaaaatggagaaagcgcttccgaagaaaaacttttctcaaataatttctgtcaataattcgcatgtgaattaaccaagacgagatcactcaaggaaatataataatacatgtaatataaatccctacaaaatcgcacgttaaaatgtgtagcctcgttaatacctggctcgcacaagtttcaatttcttagggttgtcgttcgcaggggggcaacagctggttaatggaaaaacagatttcaacagataacagattaatttcataagctacacctcacgatttgacctcaacaaacttctccacaaagtttgtggagaccaaatcatgaggtgtagtttatgaaattactatggatcttcatcaagtaacagccaaatcaataagaaaaaaaaagataacagattaagtattatattaaggcttcaacacattaaattgagaattgtcaattgcagataatggaatattgaaagttaagtagggagcgactcgcgcaacatgtgaaaattttgtctggataacacattggaaggtgaagagaatcaaaaaggcagttgtgagagcgacggactacagactggtcgatgctcaaaaaaaaaggtagatggaaaaaattcctgaaattggatgttttggtgattcaagtgtaacaacaaactttttttttggtagttaatctgtagtcaaatgattaccagtgtacatacgtcgaacagtgttacatggattcctacatgccagtttggctactactccaaacttctgaaaattgcgagctcctcagagggatgggacggacaatggtgagtgctatactcagtttgggggccccagactttaacaagacaaaaaatttttcgatagtggttatgttcaacttacagtttacctctttcatcaatgttttgatgcgtcaggtgaactgtagtatttattaccactgacgctatcaattaaatgaaaagctcacttgtttaagattgacgaagagttacaacagttcaaaaataggcaattaactgattgaaagtgccctttaataaatcaagattagattccaactgagtctcacgagagatgtgaaaaaattataaatatcaaaagatagtttgaaaaagatcaattaacatattgaaagtgcacattggcaaattgtgtttcaactggcaaatttcaaaacagactactgcttgatttgaaagattaagtgaagaaacagttcaaaatgaccaaaagaaaaattgaaaatgcaagctgtttgattaaaaagtaattgacaaattctaagaaaattgatcaacagattttaagagcgttatgtacgattacattatatataattactttgaatgtatcaaagaataaaaaacgactagtgaattataatatgtaatatttcttgataaagtttgaacttggaatcattggtttgtaggaatccatagaagtaattgataccttaaaaacacgaaagtctataaactatatgacagcgttagtgaaacaaaatgacccttctccaattttttgttcgattcttgacagatgaaaaaattcaataacaacacagaaaaaagtacgtcacagtccattattcaataaaatgtataccagactcccactatcattaatcttcacagaatctttgtatacgtcctgtaattataatttcattcgattatcaaagataatatcataatttataatctcaatgaggatattttactttttgcttcaaatcatactttaatactgaaaataaaaaaaacagaaattcgtgaaatgtgctaccgaaaaaccaatttaaacagttcccaccaattcccatctcatttttcctaaatccagaccgtctgctagaagagaaacaaaaatggttgtccagcaaaacaagaacacgttgaggagatgccagtcaaaagcaatactacagtggcactctgaagttggaaaactatcaacaaatgtacaactttacaaactatatacaagagctctcaattatctagcgactcaataaatattaaacctcaactcctagtactctgtctacgacgtaatcatatcggcctgcatttccttccccatcttcaagaccattggctctaacctcgccgttcgtcaactgaggcttttcttcactcaaacgtttcaaagtattgttctcagaatggcactcgtcagatggcaggaaaggtacattcgtgtctgtccgagtgaaaaaggccattttttctttgaaggaaataaggtccggttttccatttccaaccttcgacttcctcagtttgtagatctccttggaaactttccttagcattttctctaacttcctttcttctggagtcctagtcgtttttgaactttctgcctgcgctatcaagttctggaattgctgatcttccagcaggtatgaagcaagttctgaatcaccttgctctttagcagtctccagcctctgcttcaactccctcaacctcaacagctccgagttcagtttgtccaaccttgtatgctgcgcttggaggtccaactccaaatctatggaagtcctcgcggtggtaggcagatggctctgagacttgctcgtcgacaacgcggccatcgaaccagactgtctccggaagcgcaaagatctcctctcgaccgcgtgcctctcgaaaggtttgttgcccctcctgtacaatggcatggcactgtcgctgtcgctcctattcaacttacagatgtactgatttttggaaacgtgcgcgctaggggagaacgtctgcgatctctttatgggaccggagtcatcgacggcattaccacatcgagccgcttgaagtttcatttgtttggcttgttcaggatggaaagcacattccgtattggtttgtttgtcggtatattctggttccatgtcatcactgtgctccaaaactacatccaatctttcgttcgacctaaactcaaccgtaattccttcttcattgcaatcctcgccatcttccaaatcttcatcagaatcatcactggcatactcttcagaatccttgaaacaattatacaactcatcgaaattaagattgatggttggtgggaaaacggtctcttggtttcttgttaaagttgaagtttgagatgatatgatagtggaatcatcagaactttcttcttttcccatttgtttgtaagatgaatcgttttcagatttctcccgaaggggagaaacaacttcttgctttagataggccgtatttgagggtaggtcaccttgtagtgaaaggatgttgtaccatttctgagaaacattgtggatgttgaaatctgctaagctcacttgtgcacaacccacacatttttcttgcaggtctgccagtttattccaaacattaacttgaagtgtcttggcaaaaatcttgttggcgggaacagatacattataaacttctgcaaacgtggccttcttcaaatctctaacacttttcgtggaaaataccaaaggaggggtgggttttgcgggtaacagtgccgttttcacatatacttccgagtcttccggtatcatcaaagcactcaagttcctcgccttttctatcgtaatgttgagcatactttcagtcgtgatatatttaatcttaatttgtacttgcgcggtttcggcatctatgtcagaagcaaatgctgcggaagctcttttcctgtgagacgcctcgaacacacccgaatctccagcgacggactcgtcgctaacggcggcagaaacagatctcgtattagtaccggaggaagacgtcctggacagagcaactccttgcaacatctcatcgtga

SEQ ID NO: 722 - DNA, 2319 bp, Leptinotarsa decemlineata
  Annotation=Glutathione S-transferase C-terminal domain- containing protein-like protein (Fragment); Tribolium gene name from OrthoDB database=TC009836; Blast E-value Tribolium Gene vs. Leptinotarsa Unigene=0
aaaattaaaactcatatatttccctcatgtttcgaataaactcctaccaacaaattattcttatttgtacagctatttggtttgagcttacccaaattaacattatacccataactttctgcctgtaaccttcgatcagtatccacaatgtccatacaaaaatacccctgttttgtcttcacgttatcttcttcatgagtttgatcagcagcatgggcaaagctcaaataattcttgtatcctagtttcaatttcctgaactgctcactacgaggatatgtcacatgatggcagtccttaacacctccataacaacaagggcagacaacaaagtgtgctcgtctattgatacaattttgtataactaggtctgttgccactccacaggcatgcaaagctacgcctatatcaaaactgccaagaaaataatctaggttagactgtattatggtaacattaggtagattgagcttttgtattcgttccttcgctctcaataaagatctttctttgttctcgactaatacaatttcacaatttggtagcagaactgccaacaatattcctaaatgtccgctaccactacagaaatccacgattttatactccttgtccgaagccagcttaataacagctttggcaagattttcaagctgctcgcattttctacttgcccgctttttaggtaatgcacccccattaggatttgcctcaattggtacatttgaccagtcaaaagctgcatctattccaaatggtatacatttgttgataattacactttcaacaggagcaagcaatttaaaagctagttcaatatcattttgcttagtgtaaactcgtttttctggtctataacgggatggatcggcagtgtagagactttgtttcacaaagacaggttcgtcaataactgtcacttcttcttccgggttagaaactttcacttccaattgtggcagaccagaagcactcatcacttgaaaccatctcagtgttaatggtaatctctcctctagtaaatcaaagggagaaagttggaaaaatattttgtaacactgatacaagatcacatctgccaatgtcatcatagtaccttcactgaaagtgtgattcaagttgagtttttctataggtatttgagaagagatatctttgtccttatttttttctctagcaactttataaatattgtgcatcctcacaggtttcgataagtgaaactcaaatcttgctatatcgcctggcaagcaaaatctgccttctttgtaatacttatttttgatgatattcttcgttgtttctatgatgtcaatttcacaaaatcgagtccatatagagctctctgaacaagccataaggcaagcatctcggaatcctaataagctcttgatttctatgttagttgaattcttcagcaagtatcttgctacggaacacaagccagccaccactttttttcccgagacaattactggccactcagcaaactgtgctatttcaggaatatcaagggttggtgtatacgtaatgccatcaaaaacacattcaaccaggggttctgaaggtttggctattagcacgtcgaggtagagatcaactgtgtcagtcttaactagtttgtaaatataaaggatttccagtgtttctacacttactgaaaacgatgttgatgactcatggaatgcactgatgaaaagtttatccttggtcatagttatctttttaaacacaatttgcaagttgtctctggactcgctggagtatcctttgattcagaacttttcgtcgggttaccacacagatagtagatatgagaccaccaataaacataaatccctcaaacctccaaaatgcttgttcgccgatataagctgctctgtcacaacttcttgtaactgtttcaccgtttgcacatttcaatacttctttgtaatgggtgtgaatacatacaccaatgtttttactacgaatttcaaatgcagaacagggttcacactccttgattacatcaaatttttccttttcccagcaggtggaattctgttccaaaatgaaattagattttctgctgtgcttattggattctgtccaatgtgattccacaactaatactaaaattgttaagagccccaacaatgatattcccagaaccatacgtttcttagggcatgattcaatcatttttattttcttttatcatcaagactgtcatgaaaactagctcttgttcttctaagtgaaaataataaataattaaaaaattattcaattaataaaatgatgttctgtcatctgatagttattaataagatgtct

SEQ ID NO: 723 - DNA, 1179 bp, Leptinotarsa decemlineata
  Annotation=Epimerase family protein SDR39U1; Tribolium gene name from OrthoDB database=TC003713; Blast E-value Tribolium Gene vs. Leptinotarsa Unigene=1E-131
gaggttatggaaaatgagtagttatgtagttattttatgaacattaatgattgtatataaatacagaaaactgtggaaatgacaggacctctaaacgttcttgtaggtggcggaacgggcttcataggatctgttttatgcaatgcactaaaaacaaaaggatatggcgttacagttatttctcgtatgccaggacctcagagaatctcttggaatgaattactatccaaaggacttcccaaagatacaactgccgtggtcaacttggcaggtcaaaacgtaatggacatttcaaggcggtggacgcatggcttcaaacaaaatgtttacaattcgagaatcaacactacgaagagtctggcaaaattgattgacgaagccagtgttaagccatcggtctttgtcacaatgtcaggtgttggtgcttacaaacctgatacctcgaaagaatacgatgagaattcgtgcatagtcgaatttgacttcttctcgaagttgtgcaaagactgggagcgagcagcagcgttgaaactggaatcacaaagttcatgcagaatagttactattcggagcggagtagttcttggtagaactgggggaatgatcaggcaactgtacctgccgttttatttgggactgggtgggcctgtaggtgatggctcacaatacatgccgtggattcacatcgacgatcttatcagtttaattatttttgcaattcagaaacccactgttgaaggagtattgaatggagtagctccttatccatgtaccaataaagatttttcaaatgccttcgggaaagctttacatcgcccagccttcattcctcttccaagctttgtacttaatttattgttgaacaaagaaagagctgttatgatgaccgaagggcagaaagtgcttcctaaaaaaactattgccgcaggtttcaagtatcagtatccagacatagaaagggcatgtaaagagatagtcagtcattagcgtctttgaaacgagcaatgttttcttggagttcaatatcgatagaaaagtattccgcgatgtctggaaatgaatgtagagatgcctaaagttatgcctgcacaaacttgtgtctgatgtacaaagaagtttatattatttatattagttaattcattatattcagattattaaaaatatattttgtgtttg

SEQ ID NO: 724 - DNA, 1079 bp, Leptinotarsa decemlineata
  Annotation=Probable ER retained protein E224; Tribolium gene name from OrthoDB database=TC005068; Blast E-value Tribolium Gene vs. Leptinotarsa Unigene=7E-1; Blast E-value Tribolium Gene vs. Leptinotarsa Unigene=06
ttacaacatcttttagtaccgatttctagatgaaactagtattgaaattcaggtatgctttcaaaccaaaacatatgttaaaagcccaacagttgtcctgttccaatttttttgttgaatttatatttagaaatctcaaaaagttatttaatttctccacaaaataatcaaatcaaattcaaacacaaatcaacctgttttatcataatcacgcaatatgatacaagtatttaaataaataaaataaaaaatgtacaaacagttcttcctaatctaattatgctctataattcttcatgggcagaatgtgtgtgttgagatgaactatcggcagcatgtataaacaccccttccgctgtctgccaatgtactgaaccggaagaggagtaaactccgattacttccatttggccagttattggtctgccgaacgttttccctgatattgacaagtacatttgagtgtccacatgtttgaacataacgctatcgtctctgtgccaattatctccagaacacacaatggtccaattatccccagagtcaccttccccaccattaccgtaacaacttatttcttgattgccgctcagagggctctggaaattgtgagagtgaagatttttcttagtttccacatgctctaatcggattacggatccgcatttgatcggtcgacctctcacgcaatgcttgccggtgcctgctttgaccatccagtggctattgatatcctcctgtatttcagttcctgtaactgattgttgcccgctgcctgttccatatttcacgtcatgggagtgcaaccttactctataatcggtgttgagaagttttattaccgagccacatgttacgtatttttgtgtggaagcttgtatttgttgaaagccatgaattaaaaaaactaggaatagtacccacagatcatttttcaataatggcattttaaaagttttttatacctaaatgaactttaacatatcttccaaataatcggcaatgaacgacttctcaacaagccaatataaaatttatatttcacacaaaaacgtaaccctgtcaaacgtcaatatagc

SEQ ID NO: 725 - DNA, 2913 bp, Leptinotarsa decemlineata
  Annotation=CTD small phosphatase-like protein; Tribolium gene name from OrthoDB database=TC013017; Blast E-value Tribolium Gene vs. Leptinotarsa Unigene=8E-134
gcagttggtattctaacgtctagagtttacttttttttttttttttttttgtgtaaataaattctgtgtatttacagctgtatgttatacatagttaatataatataatatttatgtacaatacataatttcattagtttattttgttaacttctttccagcaagaaacattaatagttcaaatgacacacttcaaatactcttcagaggccaagcaagctgctccgaaaacagttttttccaaatttctattgtcaaaatcacaaattcaataaaatccaaagcagccgccttgaccgtcgaagtaactggtgatttcaaacaaaaacaataaaccgtgtacctattccatctaatttgtgtacaaatctaatttcacgcaggtagaaaaatttgaaccgactatctttttcgattgaaattgattcttatgcgctcaatagaatatcaaaattgtttcagaattgatatgttagtgaggcgacgtgagacgctcaatctggcattagttcccaaaaaaggggtcgccttgaaaatactcatataaaaaccatatgaccagcatttttacaacataaaggcctttatctttacatacaagtggttgtatatcatagcagtgttgaacgtttgtataggaaagtcctcctgaatgatgtccagaaatgaaatacttgctaagggcagaaagaaaaattcaaaggagcagctgatggttcaccatactgaaaaaccaagttgatccaaattattctaaaggaacaaggtacctaaagctctgctttaaggctgcttctcttagccatataaagcatgtgctaaaatctagtagtttgggtcagctaaacaagttttcatttcataatagtgtactttgaatactggtcagacatgatccaaaacttcagtgggaaaatttggtatttggcagcgaataattcagtcgaccttagcaattaataacgaacttcaggtgttttctattctctcttgatttcaacttgtcaattaggtgtcttaatatcaaaagtaaaactttattggattcttgttcgaaacccaatagtgcctcaacaagctgaaaaagaacaaaagcctatacatacaacgaagagctttaagatgagtcggtttaggacgtaaccgatttgcaggacaataaaataagcttactaaaaacaagtacacaccctcaaccctaagtgcttcctaattaccctgttaacaatgtgataataacctagtgatgaggtgaatctcagactttcgggcactttattcccgcgaaaactttccagaacaaacgtttcagtacagttaatgacaggtgaaaagtaactgccagactcattgttctacaacttacgacaaaggatgagtagtttgttggtacgtaaaaacttcgtagaataaagggtcctttcaagaaagccgttaccagctgtatattctcctaagaatagtgattgttacaatgtaaaataatacatttcgcgtttccaagtataactcgattataaaaaataaaaaagattacagctcgaattagcggtaatctgaggaatggagaaaaacattgaaaagttgatccataagcaagcgattagagtatcgaacaccatcttagacattcacaaagtttttgttccacaatttgaaaaacaaacaagtggtgacaagctctcaaaagcaacattacaacttcaaagacccttcttcgatcgtctttgtgaatcattccaactcttcacagtttttcctccactctggataaaatcgacagcgttaaataatagtgataacaaggaccaactcaaagagaacaacttttgctacgtcttcggaggcgagtgattgttttgaaggatcggcgagtgattggtcggcccgttgatgtggggcacactattattgtaggaggggtggttcgaattgcacagcactgtatatacattgtccatgttggcgagtttctcgaagaatgggatgaggtcgagcaactccgaatcattggcgtcgtcaaaccacgatgctactggtacagcattatctggatggaatatataggaagccggagaattgtcgacgataacgatctgtccgagctctctgccaagcttgttcaaatccttgacgtagttacccctgtaaaaaacgcagctctctctaaacagcctcttcctgaacacgtcccacttgtcgagcagatctgccacaggatcagcgtactttgctaacgaggctgtgaacagtatgcattcgtacagctcgcccatacgtttcaggaattcgtctacatgtggtcgtttcagaacgtatacttgatgtgtcgtaccgtctatttcgactggtacgatgaagtctgcgttgctaatgggcttgaaactgctatggaccaaggtctcgtccaaatcgatgaccatgcactttctgtacaagtatggttcttcgagaggttccagcaagtactccttgccgtcttcccttaccggtctattgggcggttgctcgtggttcttgtttttcgactttttctggcgaagacagcaaaacagagacctgaagaagttcttcgtggtggaggaggtcttttgctgttgctcggcctcaggctggttgaacggttcgactggaatgtcgataggttcaagatttcctttttcggtagcataactgttcagatgttcgtcgtcccttgacacctgagtaatgatggaggatgcttccatttaaacatttgtttatctcctcatgtttcacgacacattactgaatcactatattttacgcgtaactaggaagtgattgttcaaaaagtcaatagtccaccagccaccaattttcttacacagtacctccaaaaactagtagaacatggaactttaacaacaatcaacatcaacatatcactgc

SEQ ID NO: 726 - DNA, 1672 bp, Leptinotarsa decemlineata
  Annotation=Ribosomal protein L3
gggcaagaagaaggcaattcttatagaagcatctttctgaagattgccgtagacgcttctataagaattgccttcctctggcaacatgaaggtatgaaccattcactgaactcaaactcgccttatatgaagatgctaaatgagtatcaattgaagtgagagtaacggaacttattccaatctgaattgccattccgaactattcacttgattgacttatgatagcactgaatgcagagttccgagtaaagtgacactgagggaatgtctccgctaaactatgaggcaacaccctctttgttcttgcagatccctgaatgcatccattcaatgcaaataatcgctcataacaattgtcgatgtcgatacaggtacaagagcaagaagaaggcattcaccaaagcttcaaagaagtggaatgatgatttgggtaaaaaatccattgaacgtgacttcaggaaaatcgtcaaatactgtaaagttgttagagtgattgcacacactcagatgaaattgttgaaacaacgtcaaaagaaggcccacattatggaaattcaattgaatggtggcacagttgctgataaagtagcctgggctagggaacacctcgaaaaaccagttcctgtgagcaatgtatttgcccaagatgaaatgattgattgcattggtgttaccaaaggtcatggttataaaggtgtgacttcacgttggcacacgaagaagttgccccgaaagacgcacaagggtctccgtaaggttgcctgtattggagcatggcatccttctagagtttcattcaccgtggcccgtgctggtcaaaagggttaccatcatcgtactgaaatgaataagaagatatacaggattggtgccggtatccatacgaaagatggaaaggtcatcaagaacaatgcttcaactgaatacgatttgagtgaaaagtccatcaccccaatgggtggcttccctcactacggtgaagtcaataacgactttgttatgatcaagggttgttgtattggacccaagaagcgaattataactcttaggaagtcgcttctggtacacaccaaacgtgttgcgctagaaaagatcaacctaaagttcatcgatacatcgtccaaatttggtcatggtagattccaaactgctgccgataaggcctgctttcatgggacctctcaagaaagatagaaaagaagaagaaaaagttgcttcagcaccagctgctgcatctagttcataggttgtaaataccggattttattgttccgacatgttggtgcaataaataggatttgaaatatttcttttctttactatccttacatgcgagagatgagtttccacttggcgtactagtataagaaatacaacttgatagtttgtgataagtatcaaatgtcattgtaacaatatcattatgcttctgactagggcatttgtgattactgatgagtgacgaaaactgatgaaaaatagaagctagaggtaaaagttgacaatgagtgttataagggtgataaattataagggattacatgaaaaaaatcaaagaatgtttgttgcctataatttcaccaaagatctgaatacataaatgatttttattttggtatttttttactacttgaacatccaatttatgtagttttttatgacatcaataaaa

SEQ ID NO: 727 - DNA, 1196 bp, Leptinotarsa decemlineata
  Annotation=Ribosomal protein L4e
gaatatataattaggtcaacacagttaaaatgcacaaaactcatttatatgctataactatagtgacccctttcatttcttgccagaggacttcttggcttttacaggcttagcttttccttctttcttgactttcaacaactgttccctccttctcttctgtaatgctgctgacttgatgaccgcactatcagctgacaaagttattcctctcttcttagcgagctgttcgtctctctgcaacttccttttctgggcagtcaacaaagcttgtcgcttcaggactgcagcgtatggattgagtttcaacaaagctctggtattggtcaaaggattcagacggcgtacacgacgaacaaccttcttctgtggagcacgaagaacagccttgatttcatcagccttcaataacctggacaaatccgtgttggacatcttgggctgtggcaggttgtaacccttcttttccaaggaaggggtcttccagctgccgaacagtttgtccaatcgttggaaggcagattcggtccagatgacgaaacgtccaacgtgaccaccgggagcgagtttcaacaagctgagcttctccacgctgaccagatcgatgccaggaatgttacggaaggcacggcggaggccttgatctttgtggtaaacgacgagaggtcctttcctttggatgcgtcttctattacgcatcttaccttttccagcccggaatctctggctcttgtataccttttggatatcagaccatgccttgatcctcctcaagaactgcacagcctccttggtcttgctcatctcctgcactttgtcggacaccaccagaggcagctcagggatctggtcgacgacgtgccctttgctcatcacaagggcgggcactccgctagcggcgacggccgaagccagggcgtatcggcgctgattgacgttgaccctgcggtgccacctgcgccatggctttgtgggagcgaacatgcgacctccgcgacacatgttgccgaaagcaccctgaccggaacggtgggtaccgccgcccctgacacggggaatacgggcgacagcacgaccggtaccccaagactccgcggaagtttggtgaccagctttgtcgctgacactgtagggttgacgatggttcatcgatacttgttgatgaacaaagttgactacatcaggcctgatggggc

SEQ ID NO: 728 - DNA, 731 bp, Leptinotarsa decemlineata
  Annotation=60S ribosomal protein L5
ggcaacactgctgaatacatttcagattctttttccatgttgtggtcctgatgagtccaccatttttgtgagttgtccctatttcattacatttcagtaatataacatgactttcgttaaaatcgtgaagaataaacagtacttcaagcgctatcaagtaaagttcaagaggcgtcgccagggaaagactgattattatgctcgtaaacgtctcatcgtccaagataagaataagtacaacacccccaaatatcgtttgattgtacgactttctaatcgtaacgtaacctgtcaaattgcgtattctcgtattgaaggtgataagattgtctgcgctgcgtattctcatgagttgcccaagtatgggattaaggctggtttgacgaattatgcagcagcctatgctacaggtttgttgttggctcgccgattactgaagaaactgggacttgataccttgtatgaaggaacaactgacgtaactggagatgaatacaatgttgaaggtgttgaaaatggcccaggagctttcagatgctaccttgatgttggacttcaacgtaccagtacaggagctcgcgtgtttgcagccatgaagggtgcagtagatggtggtctcaacattccccattcaacaaaacgtttccctggttatgataatgaaactaagaatttcaatgctgaggtacatcgtaatcatatttttggaatccatgtagctgactatatgc

SEQ ID NO: 729 - DNA, 435 bp, Leptinotarsa decemlineata
  Annotation=Ribosomal protein L6
gactactattcaggcctccttctggtcaccggtcctttcacgatcaacgcttgccccttgagacgcatcagtcagcgttatgttatcgctactcaaactaaagtagatgtgagcaaagttgagattccagctaaaatcaatgatgaatatttcgctagaaagagggaaaagagggctaagaaggaagaaggtgatatcttccaaaccaaaaagagggttacaaagtgagtgacgagaggaaacaggaccaagagcaattagacaaacaaatcttggaggccatccggggacaccccgacaggaaagtgctgaaggcctacttgtctgccatgtggggcctcaggtcatcgcagtaccctcaccgactaaaattctagataagactacagttccataatttatttatgtattctattggtgaataaattgtggctc

SEQ ID NO: 730 - DNA, 772 bp, Leptinotarsa decemlineata
  Annotation=Ribosomal protein L7
gaattatttatttgtataaacagaacatggttaattaaaccatcctcctaagaagctcatttattttgtcttccctgtttccaaagtcaccaccttcgacgtaatggttggtcttcttgcgccatccaccagttggtgtgttaagcttgaatggccacaagaagttggaagcgttcttgaacctacttccgacagtgaagatttcgtggatcaaatcttcaacacagatgatgtcggactttcctaatttgtcttcgatgatttgattgctagtgattggcaccctttggccgttcaccttggcgaaacctctcttatagaagtctgagcagatcaaaaaacgcaaagatatcttcaagagggccgaacagtatgttaaagaataccggctcaaagaaagagatgaagttaggttgatccgacaagctaaaaccagaggaaacttttacgttcccgctgaagccaagttggcattcgtaattcgtataaagggtatcaacaaagtagctcctaaagtacgcaaggttctccaattgttccggctccttcaaatcaacaatggtgtctttgtcaagctcaacaaagctaccatcaacatgctcagaatatgcgaaccttacatcacttggggataccctaacttgaaatctgtcagagaactgatttataagagaggtttcgccaaggtgaacggccaaagggtgccaatcactagcaatcaaatcatcgaagacaaattaggaaagtccgacatcatctgtgttgaagattt

SEQ ID NO: 731 - DNA, 267 bp, Leptinotarsa decemlineata
  Annotation=Ribosomal protein L7
ggttgagcttgacaaagacaccattgttgatttgaaggagccggaacaattggagaaccttgcgtactttaggagctactttgttgatacccttaatacgaattacgaatgccaacttggcttcagcgggaacgtaaaagtttcctctggttttagcttgtcggatcaacctaacttcatccctttctttgagccggtattctttaacatactgttcggccctcttgaagatatctttgcgtttttgatctgctcagacttcttttc

SEQ ID NO: 732 - DNA, 653 bp, Leptinotarsa decemlineata
  Annotation=Ribosomal protein L7A
tatgcaatatggtacacccattttcctgcagagggcgggtaagaataacaccaactcaatagggtccacgtcgtgggcaatcactaccagctgagctttcttctgttcaatgagtttagtaacagtgttagttccagccctgagggtgtttggcctcttggtaggggcttcctctttcttggccactttagcttcggctttagccttcagcctattccttttttggagagctgtctctggtctgtatttctctaggagtttgaacaactgggtggctgtttgtttgtcaacggtttgagtaaactgattgattggcggaggaaccttcaatctcttctgcaaaacggccttctgcctttgaattcgaatgtattttggccatttgacgaacctcgataaatcacgtggaggttgaatatcctgaccgattccaaagttccttaccctcttttcgaaaagagggttaacctccttcttggactctactttcttgactgccaaaggagcagctgcaactttctttcctaccttcttcttgggctttttctggaccattttgaaaactagtttcaattaggatgaccaaaatattaaaaagttaaattatcaaatacagacaacctcgcttcagcttagctgtcttgtcaaaaagc

SEQ ID NO: 733 - DNA, 288 bp, Leptinotarsa decemlineata
  Annotation=Ribosomal protein L7A
gcttataatgtatttattacaaagttggattgaaacaagaatacaactagttaccaatctcaaccctgtttctgggcgagttccttagccctggccctttcgatcttggcgatacgagctgcggatttggaacccaacaaaccaccaccccagtgtctcctgatttcgtctgagcggtcattgaagttggttttgatgacctccacaaccttgttgaagttggacctgtcaccagaatcaacctgggtaagagctactgcagtgcaagttttgcgcctcaccaaaagc

SEQ ID NO: 734 - DNA, 1191 bp, Leptinotarsa decemlineata
  Annotation=Ribosomal protein L8
gctgttgcatagtttccagatgcccttgcaagacgaccacgatcgccagtcttttcttctaagttacatacgattgtaccttctggcatggttccaacaggcaaaacatttccaatctgcaaactagccttctttccgcaatacagaaattgtcctgtatacatcccttcgggagcaatgaataactcttttcttgtttggaatttatagggatccctgaaatgaaccatagctaatggagcgccactgagcggtgaacgactggtcgccagaagaattggcaacgtgcacctctttcatttcaagtttgtaggtgatacaaaatgggtcgtgtaattcgtgcccaacgtaaaggagcgggatcagtgttcaaatctcatacaaagagaaggaaaggagcaccaaaattgcgttatttggacttttctgagcgacatggatatattaaaggtgtcgttaaggaaataatgcacgatcccggccgtggcgctccattagctatggttcatttcagggatccctataaattccaaacaagaaaagagttattcattgctcccgaagggatgtatacaggacaatttctgtattgcggaaagaaggctagtttgcagattggaaatgttttgcctgttggaaccatgccagaaggtacaatcgtatgtaacttagaagaaaagactggcgatcgtggtcgtcttgcaagggcatctggaaactatgcaacagttattgcccacaatcatgacacaaaaaaaaccagggtcaagttaccatctggtgccaaaaaagtcattccttccaacaatagggccatggttggtattgttgcagggggtggtcgtatcgacaaaccaattcttaaagctggacgtgcctatcacaaatacaaggttaagcgtaactgctggcccaaggtacgtggtgttgctatgaatcccgtcgaacatccccatggtggtggtaaccatcaacacattggtaaagcatccactgttaaaagaggtacctctgctggtcgtaaggttggtctcattgccgccaggagaaccggtcgtattcggggtggtaaagtggatgccaagaaggaagattaaatttaaattgttaatgcttgataatatgtcaatatgttttttctggatcgtctgtgaagtaaaacttgtgtttcattagaaatatattgacttc

SEQ ID NO: 735 - DNA, 620 bp, Leptinotarsa decemlineata
  Annotation=Ribosomal protein L9
gaaatatattttattaacaaaagttattcgtcttgaacaacagtcgttttctcagaaacatacaacccatccaaaaatttacggatatccttatttttgacggttgtagactgttggatgagtgcagcagatcgggatacgtcttccaaagagtttccttcaatgattagttcatccttctgcttctgggagttggtgaccgttacacctggagccattttgactctcctgatatacttttcacccaagaaattcctgatttcaataatggaattgttttctgtggttacacaattgatgggaaaatgagcatatacggccctcattttgtattggtaacctttcgttacacctttcaacatattttctacgtgggaacacactgtcctgacagcagccaattcctttttcgtaccgaaccatttttctactctcaaggttctggggttaaccatacgaatatccaaagccaaatgtttgaaagagcgtttcagggtgcctctaggtccttttactgtgatagtacgggatttggcagtgaccgtgatcccctcagggattttgacgatttggtttgttacaatctgcttcattgtgacacttcacaccacccgcgaacc

SEQ ID NO: 736 - DNA, 591 bp, Leptinotarsa decemlineata
  Annotation=60S ribosomal protein L10
gaattttaaataactgtatttattcagtatcaaataatttaagatcttcaataaaccactgaattaatttttttttgtttcaagtcattttaattataaattgaatatttataatttatgaatgaaggtctgactgtactttcttccaagcacttagtggcccacgatctggtctgtattggacattgcaaccatcaggagccaatcgaccttctgatttcaaagtttcatattgctctcgttcatatttcgtcttgggactgtgaggtttcacaagaacaagatgggtagacgaccagccagatgttatcgttattgcaaaaataaaccataccccaagtctcgtttctgtcgtggtgtaccagattctaagattcgaattttcgatcttggtaaaaagaaagctccagttgatgactttcctctttgtgtacatttggtttctgatgaatatgaacaacttagttccgaagcgctggaagctgggcgtatttgctgtaacaaatacttggtcaagaattgtggaaaagatcagtttcatatacgtatgagacttcatccattccatgttatcagaataaataaaatgtc

SEQ ID NO: 737 - DNA, 498 bp, Leptinotarsa decemlineata
  Annotation=60S ribosomal protein L10A
gcaacattgtgatgaagctaaggcaaatggagtaccattcatggacgtggaagccttgaagaaactgaacaaaacaaaaacttgtcaagaaactggcaaaaaagtatgatgctttccttgcttctgatgctctcatcaagcagatccctaggctgttgggacccggtctaaacaaagccggcaagttccctggtcttctctcgcatcaagaatcgatgactcagaagattgacgaggtcaaggcaaccatcaagttccagatgaaaaaggtactttgcctttctgttgctgttgggcatgttgacatgaattccgatgaactggtacaaaacgtccatctttcggtgaactttttggtttcgctgttgaagaaacattggcaaaacgttaggtcgttgcacgtcaagtcttcgatgggacctccccagaggctgtactaggcaggattggggtttttatgattaaccatacatatttacttatgtataacaatacatg

SEQ ID NO: 738 - DNA, 521 bp, Leptinotarsa decemlineata
  Annotation=Ribosomal protein L11e
gccataaatatacattttaatttcttccacctcattttttgcttgctaagattattccatcgtatttctgttggaaccacttcatggcgtcttccttggtcaatcggtggctgaatcctactttgccttgtttcgccctcctgtgagctacattgaaacctggacgacccaacacaacgtagaaatctaaaccatagattccaatgctggggtcatatttgattccaagatcaatgtgttcttggataccgaaaccgaagtttccggacgctgaaaagttatcccttctcaattcatattctctcactttgagacctctctccaatacaatggtcggcctcagacaaaaaagaagttaaggacaagagcaagaaccccatgagggaattgcatatccgaaagttatgcctgaatatttgtgtcggagaatctggtgacagactcacgagagctgccaaagtattggaacaacttactggacaacagcctgttttctccaaagccagatatactgttaggtc

SEQ ID NO: 739 - DNA, 618 bp, Leptinotarsa decemlineata
  Annotation=Ribosomal protein L12e
gatttgatagtttatttccattcgaaagcctggtaaatattaagcaaatatgccaccaaagttcgatcccactgaagttaagtatgtttacttaaagtgtgttgggggcgaagtgggagctacatcttccttggctcctaaaatcggtcctctaggattgtccccaaaaaaaattggagatgatatagccaagaatacagccgactggaaaggtctgaaaatcacagtccagctgaagatccaaaacaggcaagccactatttccgttgtaccttctgctgcctctctcatcatcaaggccttgaaagagcctccaagagataggaagaagcaaaagaatattaaacacagtgggaatatcagttttgatgaaattatttccattgccaagcagatgagacctcgatcgatggcaaagcaactgtctggaacagtgaaggaagttttaggaactgcccagtcagtgggctgcaccattgacggaaaacctccacatgatgttattgacgaagttaatgatggtactatagaagtacccgaggaataatcaataaactcatttttaagtaagaacaaaaaaaaaaaaaaaaaaaaagtaactaactagacgttagaata

SEQ ID NO: 740 - DNA, 1459 bp, Leptinotarsa decemlineata
  Annotation=Ribosomal protein L13
gaaggtaataatatgattcctaatggacatttccataaagattggcaacgttttgtgaaaacatggtttaatcaacccgcccgaaagcatcgtagaaggcagaaccgtttgaaaaaagccaaagccatcgcacccagaccagctgcaggacccttgagacctgtggtaagatgcccgtcagtaagataccatactaaagttcgtgctggacgtggtttcacccttcaagaattgaaagctgcaggtcttaacccacgatttgccagaaccattggaatttcagtagatgctcgtcgaagaaacaagtcaatcgaatctgttcaactgaacactcagcgtttgaaagaatataaatctaaactcattcttttccccgttcacaataagaagaagcttcgtgctggagaagctaccgaagaggagcgtaaggttgctactcagttgaatggtgaggttttgcctattcaccagccatccatcaagacaaaggcaaaggttccctctgaagaagaaaccaagtttgaagcatacgtaacgttgaggaaagcacgcgcggatcaacgcctggttggtattcgtgcaaagagagtgaaggacgctgtagaaaaccccgaagacatcgccaaagctgcttcaggcaaagataagaaggcaaaaaagtaattcagaactaaagttttatatttaacgtgaaaaattaaagaagttttgttctgaaaggtattttttttatattgctcacatttctttttgttaaatattactggagttttatcccaacatcaaaccgttatttcaacaccccgacatgtgtttcgatcaccaagtcatcacatgttgaagtatgtaataatggtttggtgtttggattaaactccagtaatatttattactacaccaaaggttccaaacagtgcatcacaaatttctatttgttgacaaatacatacattgagttaattaaaattcttgtgaaaaatgagaatcaaaacttcctacttgtataccactgttgtttgtaactaacattactgtagtttcgtgatacaaaggcattttctaacaaatacaagtttattgtattcatttgaaaatttccttgttggaagaaacagcattaaccttaattacaaatgaaatctaccatatagtaatggctacatctatcagtcaattaaaatacttgtattttaacattgacacatagtttcaataaacaagtacagtaacccattcttcaaatttacttttttttataaaaacaaatttcagtgaagacaagtgaatttgaaaagaatatgtgagaataaatgagtatgtatgaaaacttgttaactgtatatagatcattcaaactagacaagcctaacctcctgttactattgaattacaaagaaattgctatatctttgttgacttgaacatctaactattgtgaaagaaatttaccaaatacatc

SEQ ID NO: 741 - DNA, 617 bp, Leptinotarsa decemlineata
  Annotation=Ribosomal protein L13A
gagttataaccgtaagaattaataacatctgtgaaaggttttgtctgcttcgcgactttttcagaagcagctttagtgattttcttcagcttgtcacgtttacgaatggacaacactgccttaactttacgtttagtttccaaagtacgtacaacagattggtacttccatccaacttcatgggacaatcttcctacgtgacagaacttacgtcctggtttaagacaaataattctcagagcaccaggaactacaacacgtttcctacgatcataaggtggtggaattccttcgtatgctttcaatttacgaagagcctgttttcctctctcagttttgtggggtaacattcctctcacagttttccagaaaactctggatggtgctctgaagtggaatggaccacgggctggattgacattgcaacgcttgcgaagaaatgataggaatttgagtttatttctgtagaaatttcctgatatgttcatttgttcgcacctaactacagtcactttgttgccctgcagaagtgtttttgcaacgatagcagcaaggcggcccaacaaatggcccctgccatcgatgagaatggccttttcactgaacccagtcatgtc

SEQ ID NO: 742 - DNA, 355 bp, Leptinotarsa decemlineata
  Annotation=Ribosomal protein L14
gcccttacactgcatcgacaagggttgtccgtaaagcatggaacgattctaaaataaacgaaaagtgggacgagtctgtttgggcgaaaaaggttgccgctaaagaaaagcgtttggttctcactgactttgatcgcttcaagttgcgcagggcacgttctcgaagaaatcacattcgtaccgctactttccttgtgctgaggaaaactgcatcaaggaacggtactttatatggtaagaagaaaatggctaagggaggtgataaaccaaaaccctcaaagaaaagcaagccagagaaagcacccaagaaaaaataaaagttgtaagataactaaattaaagtttttttaaagta

SEQ ID NO: 743 - DNA, 414 bp, Leptinotarsa decemlineata
  Annotation=Ribosomal protein L15
atggtaaacctaagagtcacggagtaaatgaattaaaacctgtccgtaacttgcaagctattgctgaggaacgtgtgggaagaagatgtggtggattgagagttcttaactcatactgggttgctcaggactcttcttataaatattttgaagttattctggttgacccatcacataacgcaattcgtcgtgatcctaaagttaattggatagtgaatgctgtccacaaacaccgtgaactacgtggtaaaacgtctgcaggaaagtcttcacgtggtttgggcaagggacacagatattcccaaacaaagggtggttccagacgagctgcctggctcagacgaaactctctgcaattgcgcagaaaacgataagttatgttttacttttttgataaatattaaatactacatc

SEQ ID NO: 744 - DNA, 260 bp, Leptinotarsa decemlineata
  Annotation=Ribosomal protein L18Ae
gtatataaagaatgtattcttcaaccacaacttattacaagaagtatgttcttggtttacgaactgagaagcggttcatagatttgtgttgaatacgttttggaagtgggaaacgaatctttgaatcgtggaactgtttaacttgtggtctccttgtgtcacttgccttgacttcttcaactttgataatctgtatagcatgagctctggctctgtgacgggccccatatctctgtagcaagaagttacagctccagaac

SEQ ID NO: 745 - DNA, 594 bp, Leptinotarsa decemlineata
  Annotation=Ribosomal protein L21
gagtcgtgacctttcgttgatcgtttctccatctttgttggtttctttttttctatcgaagaagtgtggaaaggtctgtaaaatgacgaactccaaaggttaccgtcgcggcacaagggatctcttcgcccgtaaattcggcaagcatggagtcatcccactctccacatatatgaaagtctacaaagtaggagatattgtagatatcaaaggaaatggggcagttcagaaaggcatgccctacaaagcataccacggaaggaccggccgtgtatttaacgttaccgcacacgcactcggagtgattgtgaacaaaagggtacgggggaagatcatccccaagagaattaatatccgcattgaacacgtcacccactctaaatgcagggaggatttcttgcagcgagtgaagtccaacgaaaaacttcgcagagaagctaaggagaaaaatgtcaaggtggagttgaagagacagcctgcccagcccaggcctgcacacatcgtcagcggaaaggtgcctgccgtgaagctagcgccgattccgtatgaattcattgcttaggtttataattttataataaattgagctttatt

SEQ ID NO: 746 - DNA, 594 bp, Leptinotarsa decemlineata
  Annotation=Ribosomal protein L21
gagtcgtgacctttcgttgatcgtttctccatctttgttggtttctttttttctatcgaagaagtgtggaaaggtctgtaaaatgacgaactccaaaggttaccgtcgcggtacgagggatctcttcgcccgtaaattcggcaagcatggagtcatcccgctctccacatatatgaaggtctataaagttggagacatagtagatatcaagggaaatggagcggttcaaaaaggcatgccctataaagcctaccacggaaggaccggccgtgtatttaacgttacagcacacgcgctgggagtaatcgtaaacaaaagggttcgggggaagatcatccccaagagaattaatatccgtattgaacacgtcacccattcgaagtgcagggaggatttcttgcagcgagtgaagtccaacgaaaagcttcgcagagaagctaaggagaaaaatgtcaaggtagagttgaagagacagcctgcccagcccaggcctgcacacatcgtcagcggaaaggtgcctgccgtgaagcttgcgccaattccatatgagtttattgcttaggtttataattttataataaattgagctttatt

SEQ ID NO: 747 - DNA, 741 bp, Leptinotarsa decemlineata
  Annotation=Ribosomal protein L23A
gacctaagcctgctgctgccaaagcagcatcatcaagtaaagctccagctgctgcccccaaaacaaaagctacagcttcaaagaccactgctaaagctccggcaggtaaagccacaaagggtgcagccaaacctgcaacgaagaaaccaactgcagcaaaagctgcacctggtaaagctaaggctccacctaaggctctgattgctaaacctaagaaaaatgttcctgttaaacagcaaaagggtgttggtaaaaaatcagccgcatctgctcctatttccaaagcgttgaaggtgcaaaagaaggtcatcaaaggtcctaatggtacccacagccgcaaaatccgtacctctgtccactttcatcgcccaacaactttgaggcccccaaggcaaccaaaatacccaaggaagagtgttcctacaggtcacgaatggatgcctataatatcattaaatttcctctgacaaccgaagcagccatgaaaaaaattgaggataacaacaccctggttttcttggttcatacaagagctaacaaataccatatcaaagctgccgtaaaaaaattgtatgacatcaatgttgcaaaagtaaacactttgataaggcctgatggtaaaaagaaggcttatgttaggttagctagggactatgatgcattggatgtagctaacaaaattggaataatataaatgttttgtatttcttttcgttatacttgacattaaaaaattatacc

SEQ ID NO: 748 - DNA, 544 bp, Leptinotarsa decemlineata
  Annotation=Ribosomal protein L24
tttttattttcacaagttcaaaaaacatttaacgttttcctcctactctaggtgcagctttcattacattcttgttggctttctgtttaggtgctgccttagtttttgctggggctgctggttttttggtggttggtttagtgcctttcttctgttcctttgcagcacggatagcttgttccctttgtgctttcctcacttcgggcctctgattcctcttggccatgatgtcattcagagatgctcctacaatagctcgctggaatttttgagttctcctagttcgcttttttgtggcctcttcttcctggcccttcctgtgcttacgtctgtacaagacagtccaagttactttacgaggattcctcttgagaaggtgagcccgttcacattttgagttgaggaaggtgaatgtctttccatcaactttaaccatagtttttccatggcctgggtaaattttatacccactgtaggcgcagagtccgatcttcatttttacaaagaattattcctcctaacacgaaactcaaactaaaaaagc

SEQ ID NO: 749 - DNA, 507 bp, Leptinotarsa decemlineata
  Annotation=Ribosomal protein L26
gctttttagtttgtgtgtagtggagaagcgtttggagtgcaagatgaaattcaacaaactagttactgcttcaagaagcaaaaacaggaaaaggcacttcacggcgccttctcatattcgaaggaaacttatgtcagcccctttgtctaaggagctcaggcagaaatacaatgtgtgcaccatgcccattcgtaaggacgatgaagtacaggttgtaaggggacattataaaggacaacaagtcggaaaagttgttcaagtgtacaggaaaaaattcgttatctatattgagagaattcaacgagaaaaggcaaatggtgccagtgtatatgtgggaattcacccttcaaaggttgtaattgttaaactcaaaatggacaaagatagaaagaagattattgatcgtagagccaagggacgattggctgctcttggaaaggacaaaggcaaatacacagaagaatctgccgcttccgctgtggaaacatcttagtatagccttatttc

SEQ ID NO: 750 - DNA, 614 bp, Leptinotarsa decemlineata
  Annotation=Ribosomal protein L27
acacacaaaaaggtgggtggattacaaaatggttaaatttatagaatctagaacctcaatttctggaaaaaccatttgtgttttccttgcttgtatctctcttcaaatttaactctggtttggaacctaatcttcttcctcttcactggatccttgaggtctttgggcgccactttcaagtccgaagtcaaatccactgaatatcttgtaggcatcaaatggttatagttgagcaccttaaggaagggcttgattttggacctcttgtgcatttttcctttgcccatacgtttgtggatttttctagggtacctatcgattccagccaccacggcatgtccatattgtttatctgacgtcccatcatcgtaattttttatgactactgcttttcttccagcgtatcggcctccaaggaccaatacgactttaccagatttcattattttacccattttgatctgaaaataaaaatgttcataacctaaaaaattactatcactgtatacaaattttgctaaaataactatgaaatcagatggcaattaagaaataattactatattcaataaatatgtgaaagattagttatactttttgatgatgtttaaaga

SEQ ID NO: 751 - DNA, 531 bp, Leptinotarsa decemlineata
  Annotation=Ribosomal protein L27Ae
gaatgaagaagaaaagttagatccggcaacaccgaaaaaatagattccttcatttctctaccaaaatgtcgacccacaaaaagaagactaggaaactaaggggacacgtaagccatggacatggacgtattggtaagcaccgcaagcatcctggaggtcgtggtaatgctggtggtatgcatcaccacaggataaactttgacaagtaccatcctggatactttggaaagctcggtatgcgtaactaccatttgaggcgaaactccaaatggtccccagcgataaatctggacaaactgtggacactcgttagtgaacagacaaggctgcagtacaaagaccatcccgagggaaaggcacctgtaattgacattgttaaagctggatactacaagcttttgggtaaagggcgcctgcccgaccagcccgtcattgtcaaagcaaagttcttctcgaaatcagctgaagacaaaatcaaagctgttggaggagcttgtgttttgagtgcataaactaggaaaataaatttgt

SEQ ID NO: 752 - DNA, 449 bp, Leptinotarsa decemlineata
  Annotation=Ribosomal protein L28
gatcttacaaaatttatttattccttctttgccttggtctttttggcaggaaggggcttctgtgacctaagtactgcgcttgccctacgaagagcggccttagtaaggtctgtgcggtacttatttgctttcaaaagacgcttcaacttgtagagggatcgcctgggaccagatttcattgtcctcttgacagtgctttgtttgggtttgcgctgtttactggcttttttgtaaacaactgtgaaacccttcttgtcagctgcatctactatgcctacagattttttgtggatgattccattatatctataggaactgagatttgtcaagttattgggttccgtactgaatggtttggaaatgttccttttcttcaatagaaaggcgttattgtttcggataattccccaaactaaatgtgacgacattttggctcgcttaaccttacc

SEQ ID NO: 753 - DNA, 320 bp, Leptinotarsa decemlineata
  Annotation=Ribosomal protein L29
ggcggatagttcttaagtaaatctcttttgacggttttattcgttagagaagaaaattctatcgcactagtttcacaatggcaaagtcaaagaatcataccaatcataatcaaaaccgcaaagcccaccgtaatggaatcaaaaagcccaaaaggtttcgccatgaatcaactctggggatggatgccaaattcttgaggaaccaacgattctccaagaggcacaacttgagtaccaaacagcaactcaaacgagctgtagaaaggaaagcagctcgtgaatctaagaaatagatgtaaattgacataattaaaaataat

SEQ ID NO: 754 - DNA, 1430 bp, Leptinotarsa decemlineata; identical to SEQ ID NO: 78
  Annotation=Ribosomal protein L31

SEQ ID NO: 755 - DNA, 374 bp, Leptinotarsa decemlineata
  Annotation=60S ribosomal protein L32
agttgttgggctcgttcaacgatttctttgcgtttcttcgacgaaactccgtgagctatttctgcacaatatttgcggttttgcatcatgaggacctcgagttccttgaggttgtgcaccaacactttacggaatccagtaggaagcatatgacgagttttggagttagatccataaccaatattgggcatcaaaaactgtcccttgaaacgccttctgactctgttatcaataccttttggttttctccagttgcgcttaagttttccatatcggtctgattggtgtctgatgaatttcttggttctcttttttataatgtttggcctgtagactggtctgatggccattatgtacagattacttatttatac

SEQ ID NO: 756 - DNA, 490 bp, Leptinotarsa decemlineata
  Annotation=Ribosomal protein L34
tattgtaaatctgaagtcatcgttaaaaaaattcagtatttttaataaattattagccaaagaattttagaaatatttgttgtgtaatttttttttagtatttgagacttttttcatttcaggacacaatggtccaacgacttgtcttcaggcgacgattgtcgtacaatactaaatctaacaggagaactatcgtcagaactcctggtggaaaattagtttaccagtacttgaaaaagcccaagaagattcctagatgtggtcagtgcaaagacaagctaagaggtatcttaccagcccgtccacaagaacggtctcgtttatgtagaaggaagaagaccgtgaagagggcatacggtggagttttgtgccacaaatgtgttaaggaaaagatcgtgagagctttctcatcgaggaacaaaagattgttgttaaagttcttaaggcccaacaagctgtaactaaagctaagaagtagacggtaataaac

SEQ ID NO: 757 - DNA, 328 bp, Leptinotarsa decemlineata
  Annotation=Ribosomal protein L35
aaaacggaacttaccagtttgagggtggctaaagtcactggaggagccccttcaaaactttcaaaaatccgggtagtccgcaaagcaattgctcgtgtatacattgttatgcaccagaagcaaaaggaaaatttaagaaagttgtacaagaataagaaatacatacctttggatttgagacctaagaagacacgtgctattcgtcgtgctctatctcaacatgagcaacgcatcaagactcctaaggaaatccgcaagcgttctgcattccctccaaggaaatttgcactcaaagcttagttgatttaataaaggttttgtaaaagtc

SEQ ID NO: 758 - DNA, 328 bp, Leptinotarsa decemlineata
  Annotation=Ribosomal protein L35
gatttttacaaaacctttattaaatcaactaagctttgagtgcaaatttccttggagggaatgcagaacgcttgcggatttccttaggagtcttgatgcgttgctcatgttgagatagagcacgacgaatagcacgtgtcttcttaggtctcaaatccaaaggtatgtatttcttattcttgtacaactttcttaaattttccttttgcttctggtgcataacaatgtatacacgagcaattgctttgcggactacccggatttttgaaagttttgaaggggctcctccagtgactttagccaccctcaaactggtaagttccgttcc

SEQ ID NO: 759 - DNA, 492 bp, Leptinotarsa decemlineata
  Annotation=Ribosomal protein L35A
gaatttgtttgatatggcagactctgtaggcaagaagaaaaaagtcgaccagaaagtcgataaagaaacgtcagaccaaaaagtttcaattaaaagaaggccaatcaaaagacatggtaggttatacgccaaagcaatatttactggttacaaacgaggacttcgtaatcaacacgagaatactgctcttttgaatgtggaaggaactgaatcaaaagatgagagctggttctacgttggcaagaaatgtgtatatgtttataaagctaaaaacaagacgtgtgttcctggacgtcccaagtctgtaaaatccaaggtacgagccatctggggaaaaattactaggccccatggtacaaggggagcagtgagagccaaattcaacagaaatttacctgccaaggcaatgggacaccgtattcgaataatgctgtacccatccaaaatataactgtatgtataaaatgaataaaacatatgcattctaaatgc

SEQ ID NO: 760 - DNA, 1437 bp, Leptinotarsa decemlineata
  Annotation=Ribosomal protein L36
atcaacttctaagtacgaagtgactgatcatttattttgcctgagatgaaaactaattgaatggactttttataacaatttgagtcatatgaatccaacttcttgagtttttcaacatgtgatataattacaaaattaaataaagctttgtttcaacttttaaatttgtttttatgttgacactctgaaagcctaaggataaaaatgtcaatacagtcagaaacaacccaaagtcaactaccgatactatagaaatttaaataataatagaatagacaggtttcaataaaattggaaaaagaaacatacaattactatatgacagattttaaaaattataaattatttctataaattacttttttaatggatttcaattgaacacataagtatagacttattagaaaatagttttcattttacaaagattgtttataatagatcaaaatagttgcattagaaagaatactgtggataaaaagaatatgagcgattagaaacaattttcaaacaaccaattgaaatgataatgagaaaagtttttagaatttttctgcacctgatagaaaacaagtacaactgactaagtcactaaaaaaataattggcaacctttcaacaataaatcaacttaaatggagaagcttttcaataaagttaaaaaagcgctaacttgaatcaaaaagacaatttgagcttactataacatgaatcaatctccaagtgagcactactacaaattaaatgcgacgtttttcaaactcttgatagaagagtcttgaagcatgaattcattgcttatgtgtcatagccaataagaaaatcaaccaacactactcataaattttcaatgaaaacattcgtgcacgaatatagatatcttatatatactcacttatattttataagcacaagtgtattattatgtgaaacagattctcaagactggtacaagaatcaacccttgatattactggactattatctaatttattacaatggaggggttcacttgaatgaccagaagaaacattctcaactgtccttaacttttattcaaatgaacactattacatttatttgtgagtagcctgtttacgcatttgagtaaggatgtttgaaagttcttcacgcttcctcttggcacggatgtgcgtgccaagacgtctcttgaggaacttaagtgcccttttatctttcgaaaccttcaacaattccatggctctcttctcataaggggcatgacctacaacttctcggataatatcacgaacgaactttgtgtgctttgtttggatccccttcaacctcgcgggacgaactttgttgatctttttgtcgatttttgtggttttgtgtcccctttggagcccaacggcgatttcgtaccttggggccatcttgttttaaacaattccgcaaacacacgtgttagccc

SEQ ID NO: 761 - DNA, 390 bp, Leptinotarsa decemlineata
  Annotation=Ribosomal protein L36
gaagacacgtgtacaattttaggtgtaaaggttaagatggctccaaggtacgagatagctgtaggacttcaaaggggacacaaaaccaccaaacttgataagtcaaagattaacaaagttcggcctgcgaggttgaaggggatccaaactaagcatacgaaatttgttcgagacattatccgagaagttgtgggacatgccccatatgagaagagggccatggagttgttaaaagtttccaaagataaacgagcactcaaattcctgaagagacgtcttggaacacacatccgagccaagagaaagcgtgaagaactgtccaacatcctcacacaaatgcgtaaacaggctacccataaatagttgtaatatttttataagaataaaagc

SEQ ID NO: 762 - DNA, 300 bp, Leptinotarsa decemlineata
  Annotation=Ribosomal protein L37
gcttctatcgaaatatttctttgattcggaaagtctgtcaaaatgacgaaaggtacgtcaagttttggtaaacgtcgcaacaagactcacacattgtgtaggagatgtggccgatcatcctatcatattcagaagtctcaatgtgcccagtgtggatacccatctgcaaaattgcgttcttataactggtcaatcaaagctaagaggaggaagaccactggaaccggccgactccgtcatttgaaaattgtacgtcgtcgcttccgtaatggattccgtgaaggtctcttatacacatct

SEQ ID NO: 763 - DNA, 287 bp, Leptinotarsa decemlineata
  Annotation=Ribosomal protein L37
gggccttcacggaatccattacggaagcgacgacgtacaattttcaaatgacggagtcggccggttccagtggtcttcctcctcttagctttgattgaccagttataagaacgcaattttgcagatgggtatccacactgggcacattgagacttctgaatatgataggatgatcggccacatctcctacacaatgtgtgagtcttgttgcgacgtttaccaaaacttgacgtacctttcgtcattttgacagactttccgaatcaaagaaatatttcgatagaagc

SEQ ID NO: 764 - DNA, 264 bp, Leptinotarsa decemlineata
  Annotation=Ribosomal protein L37Ae
gtaaatatggaaccagatatggtgcctcacttcgtaagatggtgaagaagatggaaatcactcaacacagtaaatattcctgcagtttttgtggaaaggatgccatgaagaggagttgtgttggcatttggtcttgcaaacgttgcaagcgagttgtagctggaggagcctgggtatattccacaacagctgctgcttcagtcaggtctgctgtgaaacgacttagggaaaataaagaacagtaatttaactaataaaaatttg

SEQ ID NO: 765 - DNA, 624 bp, Leptinotarsa decemlineata
  Annotation=Ribosomal biogenesis protein RLP24
tcaggacacaataagtaaaaaatatctttttcatttgcaactcaagaaattcacagggtcacctcaccaccatcttcaacaattccctccatttcttcatcactttcctcaatgctctctttctggtcctctttgcgttgtttcaacccagctgctggtgaacggatgagtgaaagatctcgttgtacttcctttatgtccttttcttgttccaattctctgccttttcttaacctctgcataatataagctttctgtcttttctgcttaataatttctactttcttcatggcttccactgctttggtgaaagtctctctgtcgtacttaacaggaatctgtctacgcttctcaaactcaaaggcaggatcaattgacaattcctttccgacattctttctatatgctttcgtccatttgactttacggggattctttttctttttgaatgcagcatgacatttagacctacagaatctgaatatcttgttatcattcctgacgaattgaataccatgtccaggatagatccttgatgaacaaaaataacatgtctcaatacgcattttgatttttatatactttcacgtgtttggatcatcaactgagattgttgtagattgt

SEQ ID NO: 766 - DNA, 701 bp, Leptinotarsa decemlineata; identical to SEQ ID NO: 638
  Annotation=39S ribosomal protein L13

SEQ ID NO: 767 - DNA, 382 bp, Leptinotarsa decemlineata
  Annotation=Ribosomal protein S2
gctttggaggagatctacctgttttccctgccaatcaaggagtatgaaatcatcgatttcttcattgggtcagaactgaatgatgaggtattgaagatcatgcctgttcagaaacagactcgtgctggtcaacgtactcgtttcaaggctttcgtagctattggtgatagcaaaggccacattggtttgggagtgaagtgcagcaaagaagttgctactgctatccgtggagccatcatcttagccaagctttccgtcgtaccagttcgtagaggttactggggtaacaaaatcggtcaaccccacacagtgccttgcaaagtcaccggaaaatgcgggtctgtaactgtacgtctcatcccagctccccgtggtactggta

SEQ ID NO: 768 - DNA, 834 bp, Leptinotarsa decemlineata
  Annotation=Ribosomal protein S3
agatgtgtataagagttaaacaggaaccggaagaacaggtgcatcaggcttcactgtcttcacctcgctgctggggtataaaggtaaaacctcatccttaggttcagcaacagaaatgttgtcgggcaaaggtttcttgggaccaattttgcctgtggcatcataaggcaacatgatcttaacttttattcccagcactccctgtcgcagcaatacgtggcgggtggcagtgtctacatagtcattgcatggatctcctgaatgaatcatgagaccatctacgaatttcatagattttgctctctgaccacgtagttttccagatacaactacttcacaccctttagctccacattccatgatatacctctgtctcttacagcaagacctccaataagcttgaacctcaaggattctgcctgggcgatagcacacaaaccacggtttgctactttttctccgtacaaaacaacggagttctcggggaaacggaatctcttttgcacaactgaagttaactcgcggattcttctgttcttctcgcccaagactctgtctgttctcgttgccataatgataatttcagtacgcgttggggtaacacgtacttccactccagaatatccatcttcggaaagttcccgagtcagaaattcattcaattcagccttaaagactccatcggctacgaatttgcgcttctttgaaatattcgttgccattttgaacggggttccagcagcaaaggaagagacacgaggtgaacacgcaaggcacggcgttgaaaaagcacagagcgcctctacctaaagtgactgcgcgcccttcaatacc

SEQ ID NO: 769 - DNA, 985 bp, Leptinotarsa decemlineata
  Annotation=40S ribosomal protein S3a
ggtctgttattagctactgtagttgtataggtatataagattgtacattgttaattatttcagtttattggattcatttgagaatgtccttgtaggacattcagtaacattagttactaataagtggtacaaaaacatagaaactttcaattaccatttttaatgattttctaccacgtagtaaccgctacatccatcaatctatgttctataatattcatatttaatattgattaaatatgaaaaatatcaaaagtatgatttacatcatttgtgctaccatagaagtctgaatactttttttaaaaattgaaaatcactaccaggtactaaagccatttggtcttgactgatagaaattacgtggaaagtttacttttagtttctctgttgcactcaaaaatacttcgcatttacttcttttccagttttattacaacattctttaaaagtttaaacgttttcttgtactggtggttcataaccttcaggcctatcaactttagagccagcatcaccaccgggttcaccagatcctcctttaccgccatcaccatgcaactccaagagcttggacagttcgaaacggggtttcttcaaaactttcactttacggatgtatacgtcgtgaagaggatagataccctggcaggctttctcaatatccttagctatactgtcaggaagaagtttatttacaactcctttcaagtcagacttttgaatttcagcgataatttttacaactcctttgaagtcagacttttgaatttcagcgataattttttcaaccattttcttacggatagccctaacttgtgtatgctgagcatagcaagtttttctctgagacaattggtctttgtttgtaaaaccaatacaaaatactcgtaacaggtatccatcagatgttttgacatcagctgaagcttcaatcaacgtctgccatttttgaccattgacctcagtttatcagtagtcaaac

SEQ ID NO: 770 - DNA, 260 bp, Leptinotarsa decemlineata
  Annotation=40S ribosomal protein S3A
taaaaataaaggttttccaaaggtggcaagaaaggagtgaaaaagaagattgtagacccgttcacaagaaaagattggtatgatgtcaaggccccgtcaatgtttgccacccgacaggttggcaaaaccttggtaaaccgtacccaaggtaccaagattgcctctgaaggtttgaaatccagagtgttcgaagtatcccttgctgacttgcaaaacgataatgatgctgaacgctccttcaggaagttccgtcttattgc

SEQ ID NO: 771 - DNA, 633 bp, Leptinotarsa decemlineata
  Annotation=Ribosomal protein S4
gcccatctactttgattaacctttgcataacaatcttagtaacttcgctgttagtcaaagcatacttcaatcggttacgtaggaagatcaccaagggcaaagactctcgcaatttgtgaggtcctgtagatgggcgaggtgcgaaaacaccctaatgtagactacatttacattagtgtgttttggcagccaacctcttgtctctttcttctgcaattgttaatttaactccttttcctcttggtagagaaacgaaggccttagcaccttttccgatgataaaaacattattcaacctagtagcgaaaacatggccattggcgtccttaacgtgtacaatgtcaaaggaacctggatgacgttccctattgatgaccgtaccaacacgacccaaattccttcctccagttatcatacataaatttccagattcgaattttatgtaatcgaggattttgcaagaggcaatctccaactggatggtgtcgttgaccttgatgtttgggtcaggataacggatggtacgtccgtcgtgtgtcactatgaagggaattcctttggggccagtttgcatcctcctgactttgcatagtttgtactttgcttcctcagcagtaatacgatgcactgcaa

SEQ ID NO: 772 - DNA, 470 bp, Leptinotarsa decemlineata
  Annotation=Ribosomal protein S4
agtttgtactttgcttcctcagcagtaatacgatgcactgcaaatcgtcctttaacatcatagatgagtcggaaaaattcaccagttttttcaatggtaataacatccataaacccagcagggtaattggagtcggtcctcacttttccatctactttgattaacctttgcataacaatcttagtaacttcgctgttagtcaaagcatacttcaatcggttacgtaggaagatcaccaagggcaaagactctcgcaatttgtgaggtcctgtagatgggcgaggtgcgaaaacacctcccaatttatccaacatccatgcttttggggcattcaaacgcttcaagtgcttcttcggacctcgagccattttgcactcaactttacaatcaaaaagaaaagagagacaccaaacttccaacaaataaaactaaaaagagacctacgaacaggaggttggtatttcttcttc

SEQ ID NO: 773 - DNA, 933 bp, Leptinotarsa decemlineata
  Annotation=Ribosomal protein S5
gctgtatattttccatgaacacaacagtttcccaatcactagacaccctttcaccaactaagttggcattttcagaagaggttttctccatctcctgaagacgccaacttggttgatgaaacgtgcaccgacgtgcagttctggtgtttagaaaagtgcttgtttcatatttattcaaagccagaggttgaagtttcgccttttattgaatataaaggttctattagtttgagaaaatatcctcagaaattaatacttgaataagcataaattaacacaaaagggattcaatcaagtgaatacaatgaagaaataacacttcttatggaaattttattactctgtacattgtgtacagaacacaagatataaaataaatttaacgattggattttgccacacgttccagttcatctttcttcttgatagcatatgaatttgaagaacccttcgctgcgttgatgagctcgtcagccaaacattcagcgatagtcttaatgttacggaaagcggcttctctagctccagtgcagagcagccagatggcttggttgacccttcgaagaggcaacagcttcttaccgtacccgccctaccaatacgggtagagtcttcacgaggtccagagttgatgatggcagacaccaaaacctgaagtgggttttctcctgtaagaagatgaatgatttcgaaggcatgtttgacaattctgacagccatcagttttttgccattgttacgaccatgcatcataagagagtttgtcaacctttcaacgatggggcattgtgccttgcggaacctcttagcggcatatcgaccagcggaatggggtagatactttgcgttcttctctttcacagcaatataatcctgaagggacatatcagacacttgaacatcatcgcaattccatctaccaaacaatttgcc

SEQ ID NO: 774 - DNA, 388 bp, Leptinotarsa decemlineata
  Annotation=Ribosomal protein S6
ggtaaaagacgtaccctgccgttagtgagaacaccctgcttcataggaaaaccttgcttgtcgtttcctcctgagatcttcagaacgtaacctttccattcgtctccaagcagatcagcttccacctcctggcccatgcgtttctcgtagaaaatacggatcttgtgttcatctacgacctccaccaatttttggcacccagttgctgggtaagacacgttcaacttcatggttattcacttgatttagtttttagaaaataacaatttctactttgatattacacacgactaaagaacaaaattctcgtcaacgtgcacatgaaaccaccatgtttcaaaagacggaattcaggaagtttctttgccgactgaaaaggaaattgtgc

SEQ ID NO: 775 - DNA, 197 bp, Leptinotarsa decemlineata
  Annotation=Ribosomal protein S6
gctctcatactggacctgcgcctcttggcgatttccctacgggccttcgattccttcttgcgttgagctagcaatttggcgtatgcatcttcttgttctttgcgtttaagacaacgtttcttcttgagagccaaacggtgacgttttctttgcagaacgactggagtaatcaaacgttggatttttggagccttggt

SEQ ID NO: 776 - DNA, 620 bp, Leptinotarsa decemlineata
  Annotation=Ribosomal protein S7
gttgatttttgtcaaggtggactttaatgagttgtgagccgtctaacctcacacgaatacgtttaccaacaatttccgcaggaaacacaaggtcttccaaaatagcatcatacactgaagtaagtgtacgagaccttggtcgtttctgtttatttgcagcacgagttttacgtgttggcttgggaagaatttttcgttcacctacaaacaccacatgtttgccactgaacttcttttccagctcacgtacaagccttgcttggactttctggaactgtttcaacttgggcattggaacatagatgataacggattttttattgttcaactcaatttctcttgctttagtaatgtgtaattccctaagctgagctttgaggtccgaattcatttctaaatcaagcagagcttgagcaacttgcgtttcgaaggcatcgggctcagccccgccggacttgatgattttcgacgacataatcggactatattctgcagagaaaacactaatatattgtttcgaccagtggtattcgtggatatttactttacatcatgcaaaaaattacaggaaaaatttactttaatacaggaacgaaacgtgtaccttgtcaatcgttcat

SEQ ID NO: 777 - DNA, 680 bp, Leptinotarsa decemlineata
  Annotation=Ribosomal protein S8
accaactcattgttgctagtcttttagttgtttcatccagaatgggtatcagccgagatcattggcataaacgaagatcaaccggaggcaaaaggaagcctctgcgtaagaagaggaagtttgaattaggtcgccccgcagctagtactaaactaggacctcgcaggatccactatgttcgtaccagaggtggtaatttgaaatatagggctctaaggctcgacactggaaattttgcctggggtagtgaaggaactgcgagaaaaacccgtattattgatgttgtctacaatgctagcaacaatgagttggtgcgtaccaaaacattagtgaagaatgcaatagttgttgtagatgccactccattcagaatgtggtatgagaatcattacatcctgcctttgggtcgcaagaagggagccaaactgactgccgaagaagaggctcttttagcgaagaaacgtagtaagaaagtacaaaagaagtacgaaactcgtcagaagacttctaaagtagaacctgctatcgaagagcaattcacaactggaaggttgttggcttgcttggcgtctcgaccaggacagtgtggaagggcagatggctacattttagaaggaaaagaattagagttctacatcaggaaaattaaatctaagaaagcaaagtaaattgttatgagg

SEQ ID NO: 778 - DNA, 270 bp, Leptinotarsa decemlineata
  Annotation=Ribosomal protein S8
acagcctcataacaatttactttgctttcttagatttaattttcctgatgtagaactctaattctttccttctaaaatgtagccatctgcccttccacactgtcctggtcgagacgccaagcaagccaacaaccttccagttgtgaattgctcttcgatagcaggttctactttagaagtcttctgacgagtttcgtacttcttttgtactttcttactacgtttcttcgctaaaagagcctcttcttcggcagtcagtttggctccctt

SEQ ID NO: 779 - DNA, 313 bp, Leptinotarsa decemlineata
  Annotation=40S ribosomal protein S9
gtactccaactctgaccaatcgacgaagaagtgcattaccttgaaacaatcttttaggttctttctcatctaaagtaagcagttctctagcagctttacggattttagcgagaacatatttaactctccatacttcacgcttgttgcgaagtccgaaagcaccaattattttcaactcctgatccaaacgtgctttttcataaggacgcctgggagttacatatgtcttggagtgaaccgaaggaaccctcccgtttaccattttggcgagtggtcacacttccttcacctctgaaactaaaatgaaagattc

SEQ ID NO: 780 - DNA, 363 bp, Leptinotarsa decemlineata
  Annotation=40S ribosomal protein S9
gtctccaaactcaggttttcaagtctggattggcaaaatctatccatcatgccagggttctgatacgacagggacacattcgagttcgcaaacaagttgtgaacattccctcttttcttgtccgtttggactctcagaaacacatcgacttctcactgaagtctccattcggtggtggccgtcctggacgtgttaagaggaagaacctcaccaagaagactggtgccgctgcacccgaagaagaagaagattaaactagggtttatacttaccaatgaattaacatcttagttggtaatttcttaaaaaataaaacgttgagaacttttcatcagaatttttaatataataaaataatgttac

SEQ ID NO: 781 - DNA, 557 bp, Leptinotarsa decemlineata
  Annotation=Ribosomal protein S11
gttgtggaacgataaatgggaaaaggaagtaactagcgcctcctgcattaattcaataaataagcacagttcttttttcccttctttcaagtgtcaaaatggcagaccaaacagagagggctttccaaaaacaaccgaccgttttcgcgaaccgcaaagtcggtcccaagactaagaaggttgccaggctgcacagaaatgttggactgggtttcaaaacgcccagggaggccatcgaaggacattacattgacaagaaatgtcccttcactggaaacgtttcgatccgtggtcgcatcctaaccggagtcgtccaaaaactgaagatgcagcgtaccatcgttattcgtcgtgattacctgcattacatcaggaaatacaatcggttcgagaagaggcatcgtaacatgtctgttcatttgtcgccctgtttcagggacgtcgagattggagatgtagtcaccattggagaatgcagacctttgtccaaaacagtcagattcaatgtattgaaagtgacaaaaggcagtagttcgaagaagagcttcaagaagttc

SEQ ID NO: 782 - DNA, 660 bp, Leptinotarsa decemlineata
atacgagtatgcttaagaaatcaaaacactgactccagaaaaataaacatttattgttacaatgaccgattctgaattggcatcatttgtatatccttcaaatatgttattttcatgtttttatctgaattccaataataactttgtcaacaagttttttgatcctcagtaactagagtatattatctttattcctgactgttccagaatgaaagatcattccaacgtcagcctacgattttcttaaaccgtaaaaaaggcgtgggccccaagagacgtaaatctttgcgatatcatcgtgaagtcggacttggatttaaaacgcctcgtgaggccatcgaaggacattacattgacaagaaatgtcccttcactggaaacgtttcgatccgtggtcgcatcctaaccggagtcgtccaaaaactgaagatgcagcgtaccatcgttattcgtcgtgattacctgcattacatcaggaaatacaatcggttcgagaagaggcatcgtaacatgtctgttcatttgtcgccctgtttcagggacgtcgagattggagatgtagtcaccattggagaatgcagacctttgtccaaaacagtcagattcaatgtattgaaagtgacaaaaggcagtagttcgaagaagagcttcaagaagttc

SEQ ID NO: 783 - DNA, 533 bp, Leptinotarsa decemlineata
  Annotation=Ribosomal protein S13
gaagctcgtagcaatttgagggttgttcttttaacgtagctccatttgtcgggaatagcgtgttttcaatttttcatttaaaaatgggtcgaatgcacgcacctggcaagggtatagcccaatcggctttaccttatagacgaagcgtacctacctggttgaaagttacaccagaagaagtgaaagagcatatattcaaacttggcaaaaaaggattgactccatcacagattggtgtaattcttagggattcttatggagtcgcccaagtgagatttgtttctggaaacaaaattttgcgcctcatgaaagctatgggtttggcccccgatctgcccgaagatttatattacctcatcaagaaagcagtggctatacgtaagcatttggaaaggaacagaaaggacaaggacagcaagttccgtttgattttggtcgaatcacgtatccaccgattggcaagatactacaagaccaagagcgtgctagcaccaaactggaaatacgaatccagcacagcatcagctttggtc

SEQ ID NO: 784 - DNA, 617 bp, Leptinotarsa decemlineata
  Annotation=Ribosomal protein S11
  Annotation=40S ribosomal protein S14
tccttttaagattctttttttgcagttaacacattgtgggtatgtttgcgtattgaaatattagtaaaattgaagaatattgtagaatctttcaaaatatagtatttatcgggtgaaagatggctcccagaaaaggaaaagtacagaaagaagaagtacagctttcacttggacctcaagtccgagaaggcgaaatagtttttggagttgcccacatttttgcaagtttcaatgatactttcgtccatgtaactgatttgtctggaagagaaactatctccagagttactggtggtatgaaagtaaaagccgacagagatgaagcttctccttatgccgctatgttagcagctcaagatgtagctgaaaaatgcaaaacattaggtattactgcactccacatcaagttgcgagcaaccggtggtaacaagacaaaaactcctggaccaggagctcagagtgccctcagagctttggctcgttccaacatgaagattggacgcattgaagacgttacaccaatcccctcagattccactcgtaggaagggaggtcgtcgtggacgtaggttgtagattttttaactgtgacatggttcattcaggaagttatctttc

SEQ ID NO: 785 - DNA, 578 bp, Leptinotarsa decemlineata
  Annotation=Ribosomal protein S15
gtcgctattattatatgaagttacagataaatcttatgaattgacggtcatcggacatttatttggtttgtggtgaatcaaagaaattagttttcattatggcggataaagttgatgaacaagtgaaaaagaagaggactttcaaaaagttcacctttagaggagttgatctggatcaacttctggatatgcctaatgaacagctgatggaactcatgcattgtagagcaagaaggcgtttcactagaggacttaaacgtaaacctatggcgttagtaaagaaactccgtaaagccaagaaagaagcccctcctctagagaagccagaaattgtaaaaacacatctacgtaatatgataatagtgcctgaaatggttggttctattgttggtgtttacaacggtaaagccttcacgcaggttgaaatcaaacctgaaatgattggacactaccttggagaattttctttgacctacaaacctgtcaaacacggtaggcctggtattggtgctacccacagctccaggtttattcctctcaaataaaatgttttgttttatttttaatagtacattttc

SEQ ID NO: 786 - DNA, 484 bp, Leptinotarsa decemlineata
  Annotation=Ribosomal protein S15Ae
gttaaataacttcacattagaagaagaatccgaggattttgcctcccaagtgtttccttctagcttcttcatggtccataatgccaccactagtagtcaatacgacatatccaaactgacgtgaggggagtaaattattcgtccacttttcaatgtgtgtaatgggcacatcaaacctaggtgaaattactccacatttattgattcttcctgttaaattaactacgatcttcccactcctatggtcgtctacaatttcaaattctccaatataaccgtgtttcatcatcacagtcaggaattttaccactactttggagcaaggccggatgagtacctgtctcttgcctcgcttctcagcattgtttatagattttaaggcatcactcaatacattcattcgcaccatggctaagaattatttgatgtttatttccgaactattcacgttctctgaaacatcgataaaggagatagttccacc

SEQ ID NO: 787 - DNA, 303 bp, Leptinotarsa decemlineata
  Annotation=Ribosomal protein S16
cttctttcaattgtccacaatgcaggcgcctacacagaagccgaaaaaggaaccaatccactctgtccaagtttttggcagaaaaaaaacagctaccgcagttgcatattgcaaaaggggtagaggagtactaagggtcaatgggcgccctttgagccaggttgagcctaaaatgctccaggacaaacttcaagaacccattttgcttcttggaaaggacaagttctctgcagtagatgtgagagtccgtgtaaatggtggaggacatgtttcccaaatctaatgctattaggcaggcgatat

SEQ ID NO: 788 - DNA, 935 bp, Leptinotarsa decemlineata
  Annotation=40S ribosomal protein S16
ctggttatctaaaaattgactcataatcgattccattttcaaacatgtatgcttgttgaaacaactttattattaaatagttacaaaactcatgcatcaaaaagctcggtggttttagagaaaagaaaatcacgttagatatgaaagattttgccactttctatttgatgaatcggacagaactcatgcgaactgagaactcaacccaatttcaattgactaggtttcaaggtactttccaaaaatcacaaacacacacttgttcatatcatactgttcattattattacctgcaaataatattttcaaaacaaattctaagaacatcactttgtcacttcacctgaaatatacctatttcaaggaacctattgaattattcaattttatgaaaaaaagatgtacaaatagatcatgtttattgtagatatctcacaagaaacacaacattatacctaaacagcttaacggtaagatttttggtagcgggcacgggcacctggaccaccaaacttcttgggctcacaacgacgaggatcagcaaccaacaatgttcgatcgtattgaatcaagatgtccttcaattcctttttggatgcttcatcaacatctgaataataaaagattcaattacaccagactttgtgaatatgtttacaaatgaatcaccttatttgattttaattattaataacattcatttccctagttgagcagtacaaaatttattttacaaaataatatacagtaacgaagaagacatccataaggtgtataccatagtataatacaattacaaacattactgatagttacacaaaaggtaaaataacacttgaaaaatagataacacatgttagagaagaattactcattttccaaaaactcctggatggtgtagcagtttttttggatgaagtaggttttcaattgtc

SEQ ID NO: 789 - DNA, 549 bp, Leptinotarsa decemlineata
  Annotation=Ribosomal protein S17
gacattagcgggctgcagctcacacagcctaccacaaacacttttaatagaagaacgtaaattttgtaatgactttaaataataaaatttacgttctttcaaggaggtttctgtttggaccacgtttctccagggaaataatacttgaatttctcaaacatgggtcgtgtacgtacgaagaccgtgaaaaaagcttccaaattgatcatcgaaaaatactatacccgattgacgttagatttccacaccaataaacggatatgcgaagaagttgcgatcattaccaccaaacctcttcgcaacaaggttgccggattcgtcacgcatttgatgaagaggctccgtcattctcaggttagaggaatttccatcaagctccaggaagaagagcgtgagcgacgtgacaacttcgttcctgaagtatctgctctggaacacgacatcattgaggtcgacccagagaccaaggaaatgttgaaaatgttggagttcaacaacattagcgggctgcagctcacacagcctaccacaaacacttttaatagaagc

SEQ ID NO: 790 - DNA, 542 bp, Leptinotarsa decemlineata
  Annotation=S18e ribosomal protein
acagtacgtccacgtctgccggtggtcttggtatgctgacctctcacacggagaccccagtagtgtctcatacccctgtgggcacggatcttcttcatgcgctccaagtcttcacggagcttggagtccagactcgaagacatcaactggttgtatttaccatcgatgatatctttctgcctgttgaggaaccagtcagggattttgtactgacgagggttggacatgatggtgatgattttttctacctcttcctctgtacattctcccgcacgtttgttcaagtcaacgtctgcttttttgaggacgatattggcatatcgtctaccgactcctttgatcgccgtcatggcgaacatcacgttccttctaccatcgatattcgtacccaagatacgaaggatgtgttgaaatttctcgggtatgaccagagacatcttgtcagattattggaacgaaaagatcctacacagaaccacgaaccacatagagaagaatgaaaacgaagaataactgaaatcaatttctcttcttcttctctc

SEQ ID NO: 791 - DNA, 467 bp, Leptinotarsa decemlineata
  Annotation=Ribosomal protein S19
gagtgacaataaagcacagaaaatgccgtctgttactttgaaggacgttgaccaacacaaattcgtaaaggctttcgcctatttcctgaaaaaaactggtaaactacgtgtaccagaatgggtggatcttgtaaaaacctcaagagctaaggaattggctccctatgatcccgattggtactacatcagatgttctgccattgctaggcatatctacattcgctcacccgtcggtgtaggttcagtcacgaaaatctttggaacccgcaaacgtaacggaaccaaaccttcccacttctgcaggtccgccggaagtatcgctcgcaaggccctgcaaagcttggaagctctcaagttgattgaaaaatcatctgatggtggtaggaaacttacccaacaaggtaggagagatctagatcgtatcgcagcccaagtgaaagctaaggagcgaaaggctcttaaagcat

SEQ ID NO: 792 - DNA, 470 bp, Leptinotarsa decemlineata
  Annotation=Ribosomal protein S19
ctgatgctttaagagcctttcgctccttagctttcacttgggctgcgatacgatctagatctctcctaccttgttgggtaagtttcctaccaccatcagatgatttttcaatcaacttgagagcttccaagctttgcagggccttgcgagcgatacttccggcggacctgcagaagtgggaaggtttggttccgttacgtttgcgggttccaaagattttcgtgactgaacctacaccgacgggtgagcgaatgtagatatgcctagcaatggcagaacatctgatgtagtaccaatcgggatcatagggagccaattccttagctcttgaggtttttacaagatccacccattctggtacacgtagtttaccagtttttttcaggaaataggcgaaagcctttacgaatttgtgttggtcaacgtccttcaaagtaacagacggcattttctgtgctttattgtcactc

SEQ ID NO: 793 - DNA, 422 bp, Leptinotarsa decemlineata
  Annotation=Ribosomal protein S20
gacctaccatagtaatcgaaatgacatccacaaaagaagtcaatccagaaaaacctggacaagacattgctccaatccaccacattaggataactttaacttcacgtaatgttcgctccttggagaaagtttgttctgatctcatcgatgcagccaaaaagcaaaagctgaaagtaaagggaccagtacgtatgcccaccaagattttgcgcatcactacacgtaaaacaccttgtggagaaggttcaaaaacttgggacagattccagatgcgtatccacaagagagtcatagacttgcattcaccatctgaaatcgtgaagcagataacttccatcaacattgaacctggtgtagaagttgaagttaccattgcagatgcctaaatgttgagtaacttttaagcattaaaggtttatttt

SEQ ID NO: 794 - DNA, 421 bp, Leptinotarsa decemlineata
  Annotation=Ribosomal protein S20
aaaataacctttaatgcttaaaagttactcaacatttaggcatctgcaatggtaacttcaacttctacaccaggttcaatgttgatggaagttatctgcttcacgatttcagatggtgaatgcaagtctatgactctcttgtggatacgcatctggaatctgtcccaagtttttgaaccttctccacaaggtgttttacgtgtagtgatgcgcaaaatcttggtgggcatacgtactggtccctttactttcagcttttgctttttggctgcatcgatgagatcagaacaaactttctccaaggagcgaacattacgtgaagttaaagttatcctaatgtggtggattggagcaatgtcttgtccaggtttttctggattgacttcttttgtggatgtcatttcgattactatggtaggtc

SEQ ID NO: 795 - DNA, 385 bp, Leptinotarsa decemlineata
  Annotation=40S ribosomal protein S21
gagcatagtgatagaagaagaagagtagaagagttagctgaaattgcattcttgtctctctctttaatttgtcgaccatttgctgtttctcatcgtttaaaggaagaaaatcctctcaaaatggaaaatgatgcaggagaaaccgttgatttatactgtcctaggaagtgttctgctagtaacaggatcattcacgccaaagaccatgcttcaatccagctgagtatcgccgaagttgaccctcaaaccggcaggatgactgaaggtttcaaaagttatgccctctgcggagcaatcagacgaatgggagaatcagacgattgcattgttaggttaacaaagaaagatggaattcttgcaaagaatttctgagtggattatgacc

SEQ ID NO: 796 - DNA, 631 bp, Leptinotarsa decemlineata
  Annotation=40S ribosomal protein S24
tagttggaaggaaacatggtactgagatgaaatttgtgaaataacttgtgaatttgacgaaattctgatgttattattacttaacctctctcgcgatttactcaaatttctcgttatgtttcagacggagggaacagcgacgattaggacccgaaagttcatgaccaacagattgttggctcggaaacaaatggtcgttgatgttttacatcccggccaaccttctgttaaaaaaacggatatcagggaaaaattagccaaaatgtacaaagtaagtatcctatatcaagtttgaaacctcgccaaatatttttatttcgttctgtaggttactccagacgtatgctttgtatttggatttaggaccaactttggaggcggtaaatcgaccgggtttgcccttatctatgacacattagattttgctaagaaattcgaaccaaaacacaggctggcacgacacggcttgtttgaaaagaaaacaggcacacgtaaacagcgtaaggaacgtaagaacagaatgaagaaagtacgaggaacgaagaaaagtaaagttggtgctgccgccaagaagtaaatcatttgtcctctggcttcagattcatatcattgtgtggctctaatctacaac

SEQ ID NO: 797 - DNA, 325 bp, Leptinotarsa decemlineata
  Annotation=LSU ribosomal protein L14P
ggaatgcctgcagagaaagcgactcaatacaagcaggcgactattccaaagaagcctcgcatcaagatgacaagaggtgtacagaccgagacaagaatgaaggttgtggacaactctggagccaaggaggtcaaggtcattggtgtcaagggctttgttggccgcttgaacaggatcccatgtgcagcaccaggagacgtgcttgtgtgctcggtcaagaagggaaagccaaccctcaggaagacggttgtgtgtgttgtgctcattagacagaagaagatttggaaaagaaaggacggttgtaacatatgctttgaggacaatg

SEQ ID NO: 798 - DNA, 446 bp, Leptinotarsa decemlineata
  Annotation=Ribosomal protein S26
gctcacaattttgacagctcttttacatccgtgcaacagagttggaaagctgtaaaaatgacttgcaaaaggcgcaatggaggacgttcaaaacacggccgaggtcatgtaaagccagttcgttgcaccaattgtgcaagatgtgttcctaaggataaagccatcaagaaatttgttattcgtaacattgttgaagctgcagctgtaagggatatcaccgaagcttcagtctatactcaatacgttcttccaaaactttacgccaagctacactactgcgtttcgtgtgcgatccacagtaaagtagtacgtaatagaagcaagaaggacaggaggatcagaactccacctcagagaaatttccctggacgagacaacaatcgcgctcagcaacaacagagaaaatgaaatgtttccattcgtttttacaataaagacctaatgtc

SEQ ID NO: 799 - DNA, 424 bp, Leptinotarsa decemlineata
  Annotation=Ribosomal protein S27
agatattgcatgcataaatttgaaaagatttcaaaatattgcacaattctgttctcacatcgtgcaaacagttcaccgagagttgataattgaaaatgatatatcaattgaatcctcaatacagttatttattagaaaacatatttgaagttacattatatttaaaagactcagtgctgtttacgtctgaaactgcaaccttcggtgagtctcgctttgcctccggtagatgtgcagaggatcgttgaacatcctttgcagggtactgcggactgggcgtgcgagaaaattgtcgaaatggcgtaacaaccagggcattttacatccatgaagtaactgttggggtgctggaccaaccttttgagtttgtgagattttctctgctgttcggcagaaggatgcaataagtcgactgctaaaggcc

SEQ ID NO: 800 - DNA, 301 bp, Leptinotarsa decemlineata
  Annotation=40S ribosomal protein S28
agtttacacacgttgtaaaaagtcctaccaaaataataaaatatggataaacccgttgtacttgcaagagtaatgaaagttctggggagaactgggtcccagggccagtgtacccaagtcaaagtagagtttatcggagagcagaatcgtcaaataatcaggaatgtaaaagggccagtgagagaaggtgatatcctcaccttgcttgaatctgagcgcgaagccaggagattgcgataatgttttattgaggtggtgtggtgaaagaagttggtcgaatttcatgcattgatgtaaattc

SEQ ID NO: 801 - DNA, 416 bp, Leptinotarsa decemlineata
  Annotation=40S ribosomal protein S28
gattgtgacatttttactaaacggttttacaaaaattaaacgtgtttcgccatacaattgcttcttcggtcgtgtcttcactaactttttttcacaatatgagagttttaaacagtacaatgcttacagatggaaaaaactgcaaaatagttatctcagtcttctagcttctctttcggattccagcaacgtgagaatatcaccttctctgacggtccccttaacgttcctgatgatctgtcggttttgttcaccaatgaattcaactttcacctgggtacattgtccctgagatccggttcttcccaaaactttcatgacacgagctaggactactggtttatccattttgctagtaagaaattgttttcgtacgtcttcacaacacgtgctcaagaacacaagtgaatgtctcc

SEQ ID NO: 802 - DNA, 361 bp, Leptinotarsa decemlineata
  Annotation=Ribosomal protein S29
cctcagttatttattcaaaatgagtttacttaacattatttacatcaacatcagaaacttagtccaacttcttgaatccaatattcaatgcatattctctgaaacactgcctgcaaagattcagtccatacttccttattaaaccatgcctgtttgagcaggaacggcaggatcttgagccttgtccgtatttacgaggatgagagaaccaaatattttcaaaacccatttttgtgaacttttatattagattgtctctctagacaatttaaacaaaatcggaacagctactacttcaaagcccccacgatgaaaaggtcgtgctaaataggatgcggaaactcgggaacactaacatgtc

SEQ ID NO: 803 - DNA, 494 bp, Leptinotarsa decemlineata
  Annotation=Ribosomal protein S30
gaattgacaattgacagcattccttttatcaagaatttttttatgtgaaaagtcgtgttgagggaaaccaaaaactccaaaatgcagttgtgcgttcgaggtcaaactacccactttcttgagtgtgaagaggggctaacaattggccaaattaaggaccgtgttgcctctttggagtctttgaaagaatctgagatcaccttgtatgctgctggtatcccagtttcagatgaaagtttggtatcggaattccaaaatgttgatattgaactgactgttggtctccttggaggaaaagtccatggttctttggcccgtgctggtaaggttaaaggacaaacacctaaagtggagaagcaagaaaagaaaaagaagaagactggcagagcaaagaggcgtatccagtacaacaggaggttcgttaatgtagtagctacattcggacgcaggcgaggaccaaactctaactctgctcctgcttcttatacacatct

SEQ ID NO: 804 - DNA, 681 bp, Leptinotarsa decemlineata
  Annotation=40S ribosomal protein SA
agttaattttttttattgatacaaaatcatgtatcacacgtcattatttaaaaacaattttattgccaatcactggaacttccccagttggtagcaacagcaggttgttgagcagtatttgtagctgtccactgttcttggacttctgctgcccagtcgtccgtaccgctagctgtatatgtaggggttgcgccaggtactacaggagcaactgctggtacctcagctgcccagtcagcagtttcattggtattccagtcaatatctggtggatccagaggagcagcaatttcagtgggtttaacaactgctgcaacagcctctttggcagcttgttcttccttttctgcctcttcaggttctctgtagaagaatagatcgactacaacctcccacttggtatcgcgttgaatagttcctcgaagacgcaggacctcacgagctaatagccaccagagaagaccaatactgtgtggagacttgttattgccaggaatagcaatgtcgacaaatctcaaaggagaatcagtattgcacaaagcaatgactggaatgttgacataagaagcttcagtaatcggctgatgatcaaaggctggatcagtaacaatcaataaacgaggttctctgaatgcagcttgaatctgatttgtgaacgcaccaggagtgaatcttcctgcc

SEQ ID NO: 805 - DNA, 3592 bp, Leptinotarsa decemlineata
  Annotation=26S proteasome non-ATPase regulatory subunit 2
aaacacaaaatgcgtttatttcttatacattggtagtacagaagttcaatacaaaaaaattgatattacaaaatgctagcaaaataactattatattcctagaaaaatttattttgaaatatcatattctctacactgaccccagatttttgactagttatcagaaaaaatgtatagtgaaatattcaatgcgagatacaaaagtataaaatatataaacttttaagaaggaaatttatgaaacactttgtgtctgaatgcatacttagtaaagataactagggaatatacaaggagaatcaaaatacaaattggatcgattttgatttccccaaattttggttctccctgtactggaaatgagtaaaaaattctcggcgagaacataccctacaaactaatcctcacttatatacaatattgtttcaacaacttatttgagacatcagaaaagtggatagtaataaataaatcactgcttctttatcacatcattttgattcttatgactgattcaaaattatcatttatatcactgttatcctaagtcttaccatggaatttcataaaacaaacataacactaatgagataaaagttaataaatacgaaatattcctctcgacacctgaaatgccaaaaggcaatttaaagaaaagggggaaaatgacaactgacgttagaaacatgatgtgcatgaccagcaatttgtattgtgtttcagtgtgttttggcaaagttatttgaaaagtagttgagtattttgagctcccgtagaattgcaattgaataattagatacagataatacaaatttgggaaacgggttttcaagaacaaactttttcgtaaagtagaaatagcggtgagggaaaaatggaaacttccaaaatcgaagtaaaaactaatgatgataagaacaaaaatgagctgtctgatgaagataagctgctgcaagaagaactcaacttatgtgtggaaaaactacaggaaagtgatgaaaaactttatttacctgctctacatgccttgggtaataatattcgagcatctaccacatctatgacgtccgttcctaaacctctcaaattcatgaaaccacattatgaaactatgaagcaagcttatgagaaagtcactaacccagaaataaaaaatgtttttgctgatattatttctgtattggccatgacgatgggagaaggaagggaatgtctcaaatatagacttctctctaatttgggtaatatcggagagtggggccacgaatatgttcgtcacttggcaggagagattgctggagaatgggcagaaactgatttcatggtgaacacagaaataagagataaattaattttactggctaagcagatccttccttataacatggctcacaatgctgaagcagaagcatgtgatttactgatggaaattgaaagacttgatctactagaacaatacgtggatgaaaataattatcaaagatgctgtttgtatctcacaagttgcataccatatgtggccgatccagaaaataatacgcttcttcagactgctctattgctgttccgcaaattcaaacagtattcgcaagcattacgtttagctatgcagttgaatgatcattctctgatagaagaaatattcacaacttgtccagatacggctatccagaagcagttggccttcatgttgggtagacaacagatttacatagaaattcccgagagtactccagaatatgaagatattatagaaattatggctaactgccacttgaacaatcacttcctgaatcttgccagggagcttgacatcatggatccgaaaactcccgaagatgtttataaatcccatttggaaaatagtcgtcctccctttggaggcagtcaagttgattctgccaggcaaaatttagcagctagttttgtgaatggattcgtaaatgcggctttcggccaagacaaacttctaatggaggatggaaataaatggctttataaaaacaaagagcatggaatgctgagtgccaccgcctcccttgggttagtcctcctctgggatgttgatggtggtctgactccaattgataaatacctgtattcttccgaagattacataaaatctggagctctgctagcttgtggtattgtcaactgtggagtccgaaatgagtgtgatcctgccttagccctcttgagtgactatgttcttcataatactaatattatgaggataggagccattgttggtttaggtttggcttacgttggttctaacagagaagctgtcctgagtctgctcactccagtattctcagatcctaaatccaacatggaagtaataggcatgtcggcattagcctgtggtatgatcgctgttggatctggcaacccccaagtcaccacaacaattatgcaaactctaatggagaaatcagatacagaactgaaagatacatacgctcggtttttgcctttgggtctgggtctttgccatttgggaaaacaggaaggtatagatactattattgccactttggaagtcatacctgaacctttccggtcgatggctacaacaatggtggacatttgtgcctacgctggaacgggaaacgttctcaaagttcagaatttgctgcacatttgttcagagcattatgaaggctctgatagcaccgacaaaagctccaaagataaggacaaaaaggaaactgttaaagaaaaagatctatctaccaggcaggctgtagccgtacttggtattgcattgattagcatgggggaagatattggcagtgaaatggctttcaggacatttgggcatttacttcgttattgtgaaccagcgattcggcgagctgtacctctggctttgggactcatctccgtgtccaatccaaagttgggcattctcgacaccctcagcaagttttcacatgacagtgatgcagaggtcgcccacaatgctattttcgccatgggattggtcggagctggtactaataatgccagactggcagccatgttgaggcagttggcacaatttcatgccaaggacccaaacaatttgttcatggttcgcatcgctcaagggctcactcatctgggcaaaggaacacttaccttaagtccttatcacagcgataggcaactgatgagtcctgtagctgtagcaggattgatggcaacacttattggattcttggatgtcaaaaatataatattaggaagatctcattatctgctttataccttagcagcggctatgcaacctagaatgcttgtgacatttgatgaggaactgaatccactgcccatacctgtgcgagtgggattggctgttgatgtggttggtcaggcaggcaaaccaaagacaattactggtttccaaactcacactactcctgttctgttggcttatggtgaaagagctgaattagccaccgaagaatatgtagccttaacaccaattatggaaggttttgtgattttaaggaaaaatcctgatttcaatccataatttttgtgctgatataaactttttctaaaatcctgtaatgttaggaatgtaataaatataataatattaacc

SEQ ID NO: 806 - DNA, 1543 bp, Leptinotarsa decemlineata
  Annotation=26S proteasome non-ATPase regulatory subunit 12
ggaacaaaaacgaagaggaacaaattagttgttttggtgtaaatgtacatgacttgtggtttataattcaattcagtttttcaaatttgaaaacttggaatatttcctagttcaactaacaatataaaataaccaacatggagtcaatagccactgattctggtaaaatcgtcaaaatggaagtggattatagtgctacttgcgacgaaaaaattcccgaatgtcaaaaattggccaaatctggcaaactacatgatgccctcgaccagttattggctttagaaaagcaaaccagaactggagcggacatgatttctacaggcagagtactagttgcagtgtgtcaaatttgtaaagaagcaaaaaactgggctgctcttaatgaacacatagtgcttttgacaaaaagaaggtcgcagttgaaacaggcggtagcaaaaatggtccaggaatgctgcacttatgttgatgagacacctgacaaagaaactaaggtcaaactcattgatacgttaaggcaagttacagaaggaaagatatacgttgaagttgagcgggctcgcctaactcataagttagctaaaattcgcgaagaagagggtaatattgaagaggctgcgaatattatacaggaactacaagttgaaacttatggctctatggaaaaacgtgaaaaagtagagctgattctagaacaaatgagactatgtcttgccaagcaggactatattcgtacacaaatcatatcgaaaaagatcaatactaagttctttgaagatgaagctgcctccgatctgaagcttaaatattatcgcctgatgatggcagttgatcaacacgaaggatcttatttggctacctgcaaacattacagggctgttttgaacacccccagcatcatggctgttccggaagaaagacaaagtgctgcgcaagcagttgttttatacctcatccttgctactcacgacagtgaacaagttgacttgactcatagggtgttggcagataaaattttggaagagattccattatacaagctacttttgaaattgttcactactccggaactgataaaatggtctggtttatgtgaggtgtacgaaaaacagctgaaatccacacctgttttttctgaagatgaggctgcaacaaaaagatgggcagatttaaaatcaagagtcgtggaacacaacatccgagtcatggcaaagtattacaccagaatcagaataacgcgaatcgccgaacttcttgatctctctcctgccgagactgaggatttcctttcccagatggtcgtcagcaaatccatccaagccaaaacggatcggcctgctggagtggtgcactttcaacaaaccaaagatcctagcgatgttctaaatgactgggcccacgatctcactcaggtcatgcagagagttaacaaaatcacacatcttatcaataaggaggagtgtattataagaaccttcaggctgtggcataacagttctttttgagtttgtaacgctggatttaacaataaaacctagtttag

SEQ ID NO: 807 - DNA, 1434 bp, Leptinotarsa decemlineata
  Annotation=Probable 26S proteasome non-ATPase regulatory subunit 3
aaaactgaatggtgtcgttctgagaagtcttatcaatcaaatctatcctgtctccgaacgtgaagctctgctgaatttcactgaagaagctgttggagatttagacaccacccaggcaagggccagatctgccaccaaatcgccattaccagaggttgatacatatataaatttattgattttggttcgtctcattgataccaataaactacaagaagcagaaaggtgttctcaggcactaatgaacaaaataacaactcaaaatcgacgtaccatagatcacatagctgccaagtgttatttttatcactctagagttgctgaactttcaaataaacttgatacaatcagagctttcttgcactcacgtcttcgtactgctacgcttcgaaatgattttgaaggtcaagcagttcttgtcaattgtttactaagaaattacctgcattactcgttatatgatcaagcagataaactggtgagcaaatgtgtatttccagagacagccagcaacaatgaatgggcaagatttttatactatttaggtcgtatcaaagcggctcggttagagtatagtgttgctcagaaacatcttgtacaagctatgaggaaagcgcctcagaacgctgctattggattccgccaaacagtgcaaaaactcaccgtcgtagttgagctccttctgggagatataccggaaaggcagatattcagacagtccagtatgaggcattctttggctccatattttcagttgactcaagctgtccgtatgggaaatttacaacgattcggcgaggtgttggagaattttggaccgcagttcaggcaagaccatacattcacgctgattttacgtttacgtcacaatgtcattaaaacggcaataagatccatcggattatcttactcgagaatttctcctcaagatattgccaagaaactgggacttgattcagcggaagatgctgaattcattgttgcgaaagcaattagagatggagttatagaagcaacccttgaccctcaggctgggtatatgagaagcaaggaaagtacagatatttattgcacaaaggaacctcagatggcttttcatcagcgaatatcgttttgtttggatttacacaaccagagtgtgaaagcgatgagataccctccaaaggcttatggaaaggagctggaatctgctgaagaaaggagagaaagggaacagcaggacttggaactagcgaaggaaatggccgaggaagatgatgacggttttccatgagtttttaacattatttgtgtatttaatgaattttgatattgcttttgttctgtatactttattactgagtagatgtttgcaataatctgtagttgatatttatttacatgcaaatagtattcaatactgaaggtttttctgtggaaatatattgattgctt

SEQ ID NO: 808 - DNA, 1233 bp, Leptinotarsa decemlineata
  Annotation=26S proteasome non-ATPase regulatory subunit 7
ggacaattggtaaattggcatcgacagtcgacgtttttggttattgttgaattttgaagtatcatcatagtctttaaaaattaagataaactgaaaatgcctagtcaagaagtgtcgacaacaaaagtaatagtgcaccccttggtgttgctgagcgttgtagaccattttaatcgcatgggaaaaattggtaaccagaaacgtgttgtaggagttctcttgggttgttggcgagctaaaggagtcctcgacgtctccaatagctttgcagttccttttgatgaagatgacaaagataaatccgtgtggtttctggaccacgactacctggaaaatatgtatggaatgttcaaaaaagtaaatgctagggagcgagtggtaggttggtaccacacaggtccaaaattagaccagaatgacatagcaataaacgaactaattaggagatactgtcccaattctgtgttggtaataattgatgccaaaccgaaggatctaggcctcccaaccgaggcatatcaagctgtggaggaagtccacgatgatggatcgcccacttccaaaacatttgagcatgtacctagcgaaataggggcggaagaagcagaggaggtgggagtggagcaccttctgagggatatcaaagataccacagttggcacgttgtctcaacgaataaccaatcaactcttaggtttgaaaggtctgcacctgcaactgcgggaaatccgagactacttgatacaagtctccgagaacaaactaccaattaaccatcaaatcatttaccagctgcaggatatcttcaatttgcttcccgatattaaccaagccactttcaactcatccttctatataaaaaacaatgaccaaatgttggttgtctatcttgctgctttggttaggtctatcgtggctttgcacaatttgatcaacaacaaacttaccaataaagatgcagaggagggaaagaaagaagaggcgaaaaaagataaagaaaataaggagaaagagaaggaaaaagataaagatgggaagaaggatgacaagaagaaataagtatcaaaaagttctgccatcatttattatttaattttttttctttgtttctaataaactatgttttgtatgaagcgtgactttttttcagattgtgtgtagtaacttgtaagaaacttcagttcaaacttgctaggaaaaatgaaaaaatgtatgtaacgaatgtttattttc

SEQ ID NO: 809 - DNA, 1306 bp, Leptinotarsa decemlineata
  Annotation=26S proteasome regulatory complex subunit p42D
gactgctaagagctggtactgctgactgctggtagtgctagtcatcgtccattgtatatcaaatatcaatttagtaaagaaaaaactcgcatagtcagttcttaaagcataatggagcccgaacgtgaaaaaggtcttcaggactaccgaaaaaaattattggaacataaagaagtggaatctagactgaaagaaatgcgggagcagttgaaagatttaacaaaacaatatgataagtccgaaaatgacttgaaagctctccaaagtatgggacagattgtgggtgaggtattgaaacaactgacagaggaaaaatttattgttaaagctactaacggtccccgctacgttgttggctgtcgaagacaattagataaagctaaattgaaagcagggacaagagtagctttagatatgacaacattaactattatgcgctatctgccccgagaagtggaccccttggtttataacatgagccatgaagatccaggagacgtcacttattctgctattggaggtctctctgaacaaattcgggaattaagagaggttattgaactgcctctgctgaatcctgaactatttatgagggttggaatcacacctccaaagggttgccttttatatggacccccaggaactggaaaaactcttcttgctagggctgtagcctctcaattagatgcaaatttcttgaaagttgtttccagtgcaattgttgataaatacattggagaatctgctagattgataagagaaatgtttaattacgctaaagatcaccaaccttgtatcatttttatggatgaaattgatgccataggtggccgcaggttttctgagggaacttcagctgacagagaaattcaaagaaccctgatggaacttctaaatcagatggacggatttgattcattgggacaggtaaaaatgataatggccactaataggcctgatacattggatcctgctttgctccgcccaggtcgtttggatagaaaaattgagatacctctaccaaacgagcaagcaagacttgaaattcttaaaattcatgctttgcccatcgccaaacatggtgaaattgactacgaggcaattgtcaagctatctgactccttcaatggagcagatttgagaaatgtgtgtacagaagcagggttgtttgcaatccgggcagaaagagaatatgtaattcaggaagatttcatgaaggcagtgagaaaagttgcagataacaagaaattagaaagtaaattagattacaaacctgtataatttcaacttagttcaaaatattttt

SEQ ID NO: 810 - DNA, 1490 bp, Leptinotarsa decemlineata
  Annotation=26S proteasome non-ATPase regulatory subunit 4
gaaagaaaaaaggaataatagagactgccaggaagtgtaagtggtgttttccttattaaagttttcaatatttgctgcacatattatatttcagggaaagtattaattgtaataatggttttggaaagtactatgatatgtgttgataacagcgattatatgagaaatggggactttgttcccagcagattacaagcacagcaagatgctgtgaatttagtatgtcactcaaaaacacgatcaaatcctgaaaacaatgtggggttgttaactttggcaaaggttgaggtattagctactttgactagtgatgttgggcgaattctatcgaaattacatcaaatccagcctgatggtgaaataaatctgcacactgggattagaattgctcatcttgctctcaaacatcgtcaaggcaaaaaccataaaatgcgcatagttgtttttgttggtagtcctgtagaaaatgaagaaaaagagttagtcaaactagccaagaagctcaaaaaagaaaaagtcaacgttgatcttattagctttggggaagacgctttaaactccgagatccttactaattttgtgaatactttgaatgggaaggacggtactagcagccatctggtaacagttccccctggacctcatctgtctgatgctttgatttcgtctccaattatccagggagaggatggaacaggaggtgctggccttagtgcatcaggctatgaatttggagttgatcccaatgaagatcccgaattggctttggccttgcgagtctccatggaagagcaacgccaaaggcaagaagacgaggctcgtagagctaaagatgttgctggaacagaaactggtactaaaacggaggcaatcaaagaggagcccaccgaagaagccctattagagagggctttagccatgtcaatggaacaaggcgaagaacaaagtacaactaacagcgcagcagttgattttgctaacatgactgaagatgagcagatcgcatttgccatgcagatgtccatgcaagatgcccaagagtcgtcaactagtgctcctccagctaaagaagaacctatggaagttgaagcagatgaagattattctgaagtaatgaatgatccagcctttttgcagagtgtcctagaaaatttgccaggtgttgaccctcaatcagaggcggtacgtcaagctgtcggcagtttgaaagataagaagaaagaagataaacctgacgaaaaaaagaaaaagtaaacttcaattcagtagcatacaaattcttattcaatatatttgctattcaaaaagtatgatgcgagtagatttgaaataatcttgaattaatgttgtgggattgaatgtattgaaactacaatttcaacattaatccaatctgctatttcaacttcactgtttgtggtaacatttctagaatattatttgcaaaaaaattgatcttgaaataagaaggtttttacaaaaaaaaaaaa

SEQ ID NO: 811 - DNA, 1369 bp, Leptinotarsa decemlineata
  Annotation=26S protease regulatory subunit 8
ggtgatttttcatatttcttcaacaaacgcaaacgaaatccatttccaagacattctttggtaaattggatatatgagaattaaatatttgctgaaaacatcgtgaatatgacggtgattaataaaatggagattgacggtgccactaaaggtgaaggcttcaggtcttactacataactaagatagaggagttacaactcatagttgctgaaaaaagccaaaatttacgtcgtctacaagcacaaagaaatgaactaaatgcaaaagttcgaatgttgagagaagaattaatgctgcttcaagaacaggggagttatgttggtgaagtagttaaaccaatggacaaaaagaaagtccttgttaaggtgcatcctgaaggaaaatttgtagtagacattgacaaaaacattgacattaatgatgtgacaccaaactgccgagttgcattgaggaacgagagttatactttacataaaattttacctaataaagtcgatcctcttgtatctttgatgatggttgaaaaagtacctgattcaacttacgaaatggtgggaggcttagataaacaaataaaagaaatcaaagaggttatcgaattacctgtgaaacatcctgaactattcgatgcccttggtatagcacagcccaaaggggtgcttctttatggaccaccaggaactgggaaaactcttcttgctagagctgttgctcaccatacggaatgtacttttattcgtgtatctggttccgagttagttcaaaaattcattggagaaggttctcgcatggtgcgtgaactattcgttatggccagggaacatgctccttctatcatattcatggatgaaattgattctattggatcatctcgaattgaatcaggttctggtggtgattctgaagtgcagaggaccatgttggaactccttaatcaactagacggttttgaagctaccaaaaacatcaaagtcattatggctacgaatagaatcgatattttagaccctgcactacttaggccaggcagaatagatcgtaaaattgagtttcctccaccgaatgaggaggcaaggttggatattctgaagatccattctcgaaaaatgaatctaactagaggaataaacttgaggaagattgctgagctgatgcctggggcaagtggagcagaagttaagggagtctgcactgaagcaggtatgtatgcactgagggagagaagagtacatgtaactcaggaagattttgaaatggctgttgctaaagttatgcaaaaagattctgaaaagaatatgtctatcaaaaagttgtggaaatgaacttttttgttactgatgttttcttaagtaataaacagtataatta

SEQ ID NO: 812 - DNA, 1271 bp, Leptinotarsa decemlineata
  Annotation=26S proteasome non-ATPase regulatory subunit 13
gtcttgtcattttaaaaatggctgcagctgcggtgcaacagtcaaatgtcagtgagtatttatctaaaaaacagcaagaaagccctaaagaactgggatctgtatgggcagaacttgaagaacttcacaacaaaaaattatggcatcagttgactctcaaactcctcgccttcataaagaaaccagagctgcagaagggagacaacttaattcaactttatcacaatttcatacaaaccttcgaaaacaaaataaaccctttatctttggtagaaatagtagccctggtagtggagcagtacaaagaccctaaagaagcagttacatttctggagaagactgagccgaaagttaaaatcaaccctgatgcccaaaatttatgtaaagttttagcaggtcaaattcatcttgaaaaactaaatgatttagatgccacaaaaaagattatagaagaagtggaagctacacttgataatgcagatgggattactgccgttcatggaaggttttatcttcttgcttctcaatattatagaattcaaggtgaccacgctcagtactatagaactgccctaagatatcttggttgtatagatttagaatctttatcagaagaaattaaagtgcagcatgccttttttttgggcctggctgctttactaggagaaggagtatacaatctaggagagcttttagcccattcagttttggattctctgaaatcgacagaaaatgcctggttgattgaactgttgtatgctttcaattccggtgatatcaataaattcgaatctatgaaatctcagtggggagcaatagctgatcttgctgctcaagaactgttcttgaggcaaaaaatatcacttttgtgtttgatggagatgaccttcaaaagaccgtcctataataggcagttgacgtttgcagaaattgcaagagaaacaaaactacccattaatgaaattgagctattggttatgaaagctctttcccaaggacttgtgaagggtgctattgatcaggttgccaatactgtaaacatgacctgggtacaacctcgtgttttaaacctcatgcagatctctggtatggttgagaggttcaacgaatggtgcgaacatgtgggcaccatggaaaaccttttagaagaaaaagccagtgaaatattaactttgtagtaggtactaatgataacatgttttttggatataatttctaaaacagttgtgaaaatttgtgcaaaagagtaaataaagtgttgattcctaaat

SEQ ID NO: 813 - DNA, 802 bp, Leptinotarsa decemlineata
  Annotation=Putative uncharacterized protein
agacaatagacagaaacatcaaacataaatagaaaagagtgaattctaaaaattcatcatctttggttataaattgaaagattattggtggttcttgaataatcatattgttaaggcaaaattgaaatgtcagaaaaaccaaaattagatcttggcgtcctggaggaagatgatgaatttgaagaatttcctgtagaagactggacagggaaggaaaaggacgatcaagacattagtgtatgggaagataactgggaggacgacaatgttgaagatgatttcaataaacaactgagagcacaactcgagaaacaaaaggccaaacctccatcaaagtgaagttacttttatatctcaatgtagtttaggtaatatggaacttaataaactatattagccacacgaaacagggataaatttatttgactatgtacattaaaagctagtttaatttgatttgtatgtgtttctgttgtattgatttatactgaaaaaattgtttcagcttccaatcttgccttttaacatgtccaccctgtatattattttttaggctacctacatttttatatctcaagatttttcaatgaacagtttgcgaaaaaacctaaattcaaagttaacaacacaagaagctttgaatctaggtcaacagtgccctttctatacccagtatttcctttaataactatactgtttttcaacccatttgctgcatatgaagtctgaaggtatcgtacagctaacagtacactgtgcatgatgtcttcaaacgtcattcatataatgaaaaatagaactt

SEQ ID NO: 814 - DNA, 2048 bp, Leptinotarsa decemlineata
  Annotation=ADP-ribosylation factor GTPase-activating protein, putative
gtctgttttctcctttgtgaacaagtttcgtgtttcatgaaattgacattttctggattgttggacacgtttaaaaatcccaatccaatcgttaattgatttaacatataatcctccgactttccagtttacacaaactctcatcatttgttcccttttgcttggtcctataaattttttttatcgtaatgtttttgatctgaactccaaaatgatttactagaatcaatccatacgttttgatcagtattttctaaactattgttcttctgatagaatttaaattaaaacatggcaagtcccagaactcgtcgacttctacaagagctaaagcctcacaatgaaaatgataaatgcttcgagtgtggactccataaccctcagtgggtttcggtaacatatggcatatggatttgccttgaatgttctggcaagcatcgtggcttaggagtgcatttatcttttgtgcgctccataactatggataaatggaaagacatagagttggagaaaatgaaagttggtggtaacagaaacgcaagagtattcttcgaggcgcagccagattgggaagataccatgtccattcaacaaaaatacaacagtaaagcagctgcattgtacagagataagatatctgcgctagctcaaggaaagtcatgggacgaacagaagtctcctgctcaaaattacaatagtagctttgtaggatcttcctctcaaaagaacagctcaagagatactcattccacgtcaaatttcactagatcttattccaacagtaccgaaagttaccaaggtgcctaccaaaatttaaattcaccagagtttcggagtcagactgaaactttctttgagagaaaacagtccgagaatgctaatcggagaagtgatctcccgccaagtcaaggcggtaagtacagcggtttcggatataccaaagaacaacctccaagaagtcagtcccaagagtttgttgacactgccatgtcatctttagcaaatggttggtctttcctttcatcgtcagccaccaaaatagcaagtaaagcaactgaaaatgcagtgaagtatggtggattcgccagccaaaaggttgttgaaattggatctcaagtaggagaaaaggtaggtgagttgagcaagaaaggttggcgagaagtcagctcgctcagtagcgacaacccaggcgcatattctcaagtggggggagacaactattctcctggtgagaagtcttccttatacagtggaggaaacagctatgttcgagacgactggagttgtagcagccaacagggttcaaaggcctcaagtcctaaaagcgcaagtcagaactggaatggaacaggagaatcgtcgtataacagtcctgttatgtcgccagttgaagagttctcgaagaaatcagaggcaaaaagtaaggaggcacgaaatcaaaagaaatggagcgccggctgggaagaggatgcaatgtgggaaagtttgaagtaatttattttcaagtacttagaataaataattcgtattgagagggctcggtaatagtatgcgaagcctgttcagtgtattgaatttctccaaatattcagaacaaatacttttttatttaggcatattttaatcaatgtgaaactgttgctttggagaatctgaatgtatttaaatattataccgtgtgtccatgaagtaaggcaattcattgttagctaaatgaacaatattcttgttttttaataatatgatttattcggcttataatgaatttaaggacatactgtatataattttggtttcgctatggtagctgtctgaaatatataaaaattaccatgatgaaattatctttattgaacttgttctgtgttcagaaataatctgatgtatgatgttgatgtcagttgtgctgaagtaaagccagtcatcctgaatgtatattgctttagctgaattttactgcttgacaaattcactgtaaatacttctggtgcaaacaagttcaaattaacaggaacattattagtcccaattgtatatttagagacacg

SEQ ID NO: 815 - DNA, 3747 bp, Leptinotarsa decemlineata
  Annotation=Golgi-specific brefeldin A-resistance guanine nucleotide exchange factor, putative
acgattatgaactatgggttgatgtcaaaataaaaatacttcaatgaagtagtttttaaaacgtgtactaaattcagatgataacactttttcaaaagagtattcaaaatgaatttacctggcaatggaatttttgtagtaaaaggtgaaatatctgttttgatgatagcaatgcgccgtggaacaagatggtcttcacactcctatcaagaagatgatgcccttatgaaaaattttcaggaactccgtgaaatacttgataatgtagatgacttaagatttgttgaacccatcacttttctgtcgccttttttaaatgttataagatctgaagaaactacaggtcctgtcactagtttagcattatcatctgttaacaagtttctatcatatggtatcatagatcctatgcacgcctcgataccacaagctatacacaacattgcagatgctgttacacatgcaagatttgtaggaacagatcagtcctcagatggtgtagttttaatgagaatccttcaggtattgagaactctcactttatctcccgagggggttaatctaacaaatgaaagtttatgtgaaattatgctgtcatgcttcaggatatgttttgaaacaagactcagtgaacttttgagaaaaactgctgagcattatttgaaagatatggttcacttagtttttatgagacttccacagttttgtgaggatttaagaacaaccagtataaaacagtttcaaatgcgtacgggaactttggaccagactagaacaaaacgaaaaaataaacagacataccgaaaaagagaaaaagttgattctgaaggtattcagtcctttgttccaccaaaagtagttcaagattcaactccaagttccatatcgtcaacaccattaacaaccctatctgttagtaatgtagtagatttacaaggttctattttacaaaatattcattccatgagttgtgataccattgaagtaagtgaactttcgtttccatcacctgttcagaatgaaggttatatatctgatttggagtcaggtatttttagtactcaatctaataattcagaaatgaaaaatgttcaatgtgacgatcaaatttcaaataccactgaacacaatcatcatgttgagactgaagtatcccaaattaactcacaggatgatataacaaaagcaaaagaaaccgtcaatgatggcacatgtgattcttcaaatgattctagtcaagagtatgttaatcaaagaggtataaggtttaccccacaactccaccaagaactaatattgtctccatacggccttgcatgtgccagagagcttttcagatttttaataagtctttgcaatctattagataaacaaaatactgatgttatgattcatctaggattgattttattaactgtggcatttgaagttggtgctgaaagtataggaagatacaacactttacagtttttagtcaaagatgatttatgcagaaatttattttctttaatgagtactgaacggctctcggtgtttgctgcagacttacaagtagcatttttgatgttccaatctcaaaggagttttttgaaatatcagttggaattctatttaaaaaaattgatggacattttatcgagcgattcaactaagataacccacgaacatagggaaattgctatggaaaacctgctccagttgtggagaatacctggtttccatactgagttatatttaaattatgattgtgacctatattgcctcaatctatttgaagaatttacaaagttgttagccaaatttacgttttctgcgacaaatggattgaatcaaacacagttgttgtcattggatgcacttcttatcactattgaaggaatcgaaaagcgatgcaaagagaaaagcaaacaaaaaatattaaataatgaaataagcttaaatgacagtggatctagagaaaatatatataattataatagatcttcaaaagtgaaatcagctgataatgtgccaaataaggaagagctagctcataaaaagtttttgaaaaaatggttacctcagggtacagagtatttcaaccaaaaacctaaaaaggtatagaatttcttcaagaacatgggtttcttaaacctgtattagacatagaagaaattgtgatgtttttgcgagaaaatcctggtctaagtaaagctatgattggtgaatacataagcaataggagcaatctgaagattttagaagcttttgtgaaaacattcaacttcacagatgttaggatagatgaagctttgagagcgtttttggaatctttcagattacctggtgaagcacctacaatttcacttattttagaacattttgcagatcattggcacaaaagtaatggggaaccttttgctgatgttgattcagcctttactttggcctatgcaataattatgttgaatgtggatcaacataatgaaaatgcaaaaaaacaaactgtaccaatgagtgcttctgcatttaaaaagaatttgaaaggcgttaatggtggagatgactttgatgaagaactactcgatgaaatttataatacaataaaaaatgatgaaattgtcatgcctgcagaacaagcaggtatcatcagagataattacctctggaagttactgttacggaaaggtcaatcaaaagaggcttcgtatgttcatgaaaatagtggcacatatgattttgaattatttcagattctatatggtccagctgtgtctgctctatcatctggttttgaaaagagtgacaatccaagtatatacaaaaaaataataaaggggtttgaacagtgtgcctttatagcttctaatctgaatattcctaagagtttagacatgcttcttttgacaatctctaagttttctctattccataatgggggaagacaaaacaatgttgttattcagtttggagcaaataataaagcacaattggcattgaaaactttttttgccttgttccatcttcatggcaatagcattacagaaggttggaaaactttgtttgatttaatgttgtccttatacaccaatgacttgctctccaaaactttcactgaaattgaagatttcattgaaccaagtggaaaatttgtgttacactttgaagaggctcccaatttggaaaaacaagatacaggtctcttgagctcattatattcctacatggtttcagctgaaaatctctcgaaagtaccaacacccgaggaacaatattttattgaaataaccaaagaatgtataaaagattgtaatttggatcagttgataaccgactctaaatttctccatgaaaatgctcttctggaaatggttaaaactttgatagagttatccagaggacctgacattcaagaaagcctggggtacaactataatcagaatgtaacagtgtttttcttggaactccttataaaaattgttatgcaaaatagagatcgagtaatgtcaatatggcagaatgtacgagaccacatatatactattgtaatgaatgcatctctgtttgattaccagttccttctggagaggtcagtaataggattattacgaatagctatacgtttgatgagaaacgaagaatgagtcatatagttctgcagtcacttcgaatgctgtcttctgctgaaaagtagtacattaagcagaatatcccgacagatctcgtttggattatttgaattattgaaaacttctgcccagaatatac

SEQ ID NO: 816 - DNA, 4575 bp, Leptinotarsa decemlineata
  Annotation=Sec24 protein, putative
gggacttacgtggcagacgtaaaagtgtatttgtgggatgttctttatttacagatttttatagaatttcactgttaaaataacgcaatatcattttgatatggaaccacaatatatgcctccacaacagtttggaggcccacaacaaggatttcctcccaacctatcttcacaaggattaggacaacagcaaccctttcaaactgttcccctggaatcaccaagacctgggcaattacctcctcagggagggattccttctaataagtgcacacttccttcaggagttccagtatctggatcatctccgagttatctaacatcgccaggtcagctaccaccatcaagtcagttaccacctacaaatcaactaccaccctccactagaggtcaaattccacccagtcaattacccccttctattggtcaaaacactcagagtatgaattcacaacatccaagtgcattcagtcctccactatcaaaaaatgaagttcaacctggaaatgttcaaaatggtccccaacagtttcaaaacggacaaatgccagaccaatttccaatgaatcaggacaaaaaaactccttcagggatgactgttccaccaaacgttccatcaaatactcagaatcagaatcagtttggtcccattccaacatcaaatcaaaactttccacctaaaccattgtcaaaccagcttggtcagaccccattgtcaggagttccaacattccaatcggctggagctccgggtttgccatcatctacccagaatcagtttggacaacctcctgctcaattacaaagtcaacacaatcaactaccaacagctcagggaatgagtgctggtcctccaaaacaaacccaacccatacagcaatctctgccaagtcaaaatattcctactcaactacaaagacctggacagccgctcttgcctggacaagggacatatcctaaccaaggtccccccatgggtcaaggatcttttcctgcacagggaccccagctagatctgggatcttctggtcaaggttttccacaaaatcaaagacctccagttggttttactcaaggtccaccacttggtcacgcctctcctcatcttagtcaaggacctcctctgtctagtcaaatgtcatctttgtctggacaaagacctcctttacctggacaaaggcccatggataatgctaatccagcactagtaggacaaaatccttatcaatttgcatcaggaccctatccaccaggggtggcgtatccgccacaaggtccccaaatgcctgcacaaagcagtcaatcacagttggtttccaatcagataacaaaccaaatgcatgggatgagtttaacaggacctaggcaatatcctggagcaccagtgaaaagcaccatcaatggagatagcggtccccacatgccaccaccactcggtcagtctggtttcatgaatggtcagcaaacgagaggtccccaacaattagcaagatatccaccaatgcctggtcaagggtccatgcctggacaaggatctattcctgggcaaggatctatgcctggaacaggacctatgcctggttcagggcctatgcctggacctctacccggaataggttctatgcctggacaaggccctatgccgggacaaggactagtaggatctggttatcctcaacaaaactaccaacaaccgcaacagaatcgaaaattagatccagatcaaatgcctagtcctattcaagtaacacaggatgatcagcaaaacagatctggtgtattcgtcaccaatcaaaaaggactcgttcctccactagttaccaccagttttgttgttcaagatcaaggaaatgctagtccaaggttcattagatctacaatgtataatgtaccaatttcacaggatattctcaaacaaacatcagttcccttcagcgtagtgttgagtcctatggctaggcacatggatcaggagtattccccaccaatagtgaattttggtgaattagggcctgttaggtgtatacggtgcaaagcctacatgtgcccatttatgcaattcattgattcaggaagaagatttcagtgtcttttctgtatggctacaactgatgttccaacggagtactttcaacatctggaccatactggtcaacgaatggatcgctatgaaaggcccgaattggtcctcggtacctacgaattcgttgcaacagcagattattgtaggaataatactttgccaaatccgccagccattatttttcttatagatgtttcttacaacaatatcaaatctggcatggtgaaccttttatgttcccagatgaaaaacatcattcagaatctacctgtggatcaaggacaagaaaaaagcaatatgaaagttggattcattacttacaatagttcggttcatttctataatataaagggtacattggcagctcctcaaatgttagtagtgggagacgtacaagagatgttcatgccccttttagacggattcttgtctactccagaagaatctggtccagtaattgatgctcttatggaacagattccatctatgtttgccgattctagagaaacagaaaccgtattgtatccagcaattcaagcaggattggaagcacttaaggcttcagaatgtgcaggcaaacttttggttttccattccacattaccatctgcagaagcacctggcaaacttaaaaatcgtgatgaccgcaaagtactaggaactgataaagaaaagacagttttaacccctcaaagtcaggtttacaatcagttgggtcaggattgtgttggagctgggtgttctgtagacttgttcatattcaacaattcatacattgacatagctacaatcagtcaggtttcgagattgacaggtggagaagtctttaagtatacatatttccaagctgatatcgatggcgaacgacttatcaatgatataatcacagatgtcagtcgaccaatagcttttgatggtatcatgagggttcggacatctactggagttcgtcctactgatttttatggtcatttctttatgtctaatacgacagatatagaattggcatccattgattgtgataaggcagtagcaatagaaataaagcatgatgataaactatctgaagaggcaggagtttacctgcaagccgccttactctatacttcatgttccggtcaaagaagactgagaataataaatctttccctgaaaacttgctcacaaatggctgacctttatcgtagctgcgacctggacacattagtaaattacctgagcaagcaggcagtatataaattactggacaacaaccccaaattggtaaaagattctattgtgagcagggcagcacagatattagcgacttataggaagaactgtgcaagtcccagcagtgctggccaactgattttgccggagtgcatgaagttgcttcctctatatgtcaactgcctcttgaaaagtgatgctttatctggtggatctgaaatgacgattgatgacagatcttttgtcatgcaggcagtaatgactatggacatccctacttctatgaatcacttttatcctaggcttattccagttcacgatattgatcctacaaaggaaccagttactattccaccacctgttcgttgtagtattgagaagatgaacgaacaaggagtttatatattagaaaatggaattcacatgttcctttggtttggcttaggcgtaaatcctgaatttattcaaaaagtatttggggctccatcagccatacaagttgacattgatagggttggattaccggaactagataatcccctttccatagctgttaggactatcattgatgaaatacgaatagaaaggcatcgttgtatgagactaacattggttaggcaacgagaaaaattggaacctgttttcaaacattttcttgtcgaagatagaggcacagatggttctcctagctatgttgattttctgtgtcatatgcacaaagaaattaggacgttgctgagctagcagaggtgatctttaggttacggataagagattttaagaagctgtgggaatgtaatcgaaagtttgtgtttgatggattttataacatacttcaattacaatcatccatttccagacgtgctgaacagaatatattttatttttatttgttatatgatgtatattagaatgataaagcaagcttgccccaaagatcattttcatgaaggtaattaagtattatatttcgacgattttgacttctttctttacttcactactgagtataaaattcaagagaagttttcattgcttcttgaaggcagtaaaatggacataaaagaactggatatgtttttaaaaactatcaagtagcgatgtttaaatgaaaactgaacgttttacagttgctttgttttgacttttattaatgaatcaaaattttatttactttgggtgcgagttagctctaggagagaaattaattgctagatttatatttaaggattttgtaactatattttatttgtactctatggttatgtaatatagatact

SEQ ID NO: 817 - DNA, 5897 bp, Leptinotarsa decemlineata
  Annotation=Protein transport protein Sec24B
gattgacaatgacgtttgggaaaataattttttctcatttaagataattttctgagaaaatgtgtgaggaatctataataaattgattttggtgcaaggaaaattgaaaactcaactcaacatcaatgttatgatggctgaacaaaacttgaacggagtttccctcagcctagaaaatctgaaacagaatgtaccagttgatggaaagatgtaccaacagttcaacggagtacactcttcccagtcatcaagaagttcaactccacctgttcgacttgggcaaattcctccaactcagcttcctcccaacaggccagttcctcagtcccaactgccgccttctagatccccactcaccaatgtcacccaacaagttggtgcactcagcatacagcagatgccgcctagtgtcagtacgaagtttgaaaccatcagtctggaaaacaagcccgttttttcgtcagcttctccggtaccaaaaacgcaagtaactcaggccgaaccgttcagaagtttttatgataaagatgatgtgaaaaatgtagtgcctaatgtaccaggtgtgcagaagactcctcataatttctctccaatgtctcagactagtttaaaccaaaatagtagtcaatacccatatggacaaatgcaaaatcagcaatcaaatgtgggtccttcagttagtaccacccagggaaatgcccaatctgggttaaataggactaattttatacaaacgcctgtgttatcgtctcagaattttgtgaataaaccaactgttccactagagtccagtagattgaaccagtactcaactgtgcaaagtcaaagcaatccaattcaaactggtttgaaccagggtcagtacctgcagcatcctgcaagtagttcaagtactcagtatagctcaaataatacaagcggcagtcacttacccaatttgagtcaagtcaacaggaatatagcaaatcaaattccggggtcaacagttcctcctttggtaaatccagcacatcaattctcgaaccctcagaaattctcccaaatgtcacagatccatcctagtacaaaccaaagatatgtaaacccgaatcatgcacctaggccaatgctgaacatgaataacttacagaacttttctgcgaatgcaacccagccgaagatgccaccaagcagtgtttttcctcctcctgtatcaaattttcaacccaccactgttccccaaacgaactacttaactggacctccacttcaaaacctggctggtcaaaaacctgttatgcacaataaccgatatccgacgtcttcaaatacaagttatcagcaaccacctgctagtcagtataacgctcctccttcacagacgattcagaagccaacaggttatcagcaaccgatgcagcagcaaaactcctaccaagctcagaatcagtacaggagtgtcctagacactggtttcaacaatgcctgggggacacagagctatgaccttttgcaactcccaaacatactgcccccttcgaaaatagaccctccaagggtttgcttggggcaagaactgctagaccaagccaactgcaacccggacgtgtttcgatgcaccatgacgaagatacctgaaaacaactcgctgttgcaaaagtctcgtttgccgttgggcatcctgatccatcccttcagggacctcagccacctccctgtcatccagtgcaacgtgatcgttaggtgcagggcttgtcgtacctacataaacccattcgttacttttgtggataacaaaaggtggaaatgcaatctttgctatcgagtaaatgagctgccagaggagttccagtatgaccctgttagtaagacctacggtgatcctagcagaaggccggagatcagaacgagcactttagagtacattgccccagctgagtatatgctgcgcccccctcaaccggcagtatatctcttcttactggatgtgtctcgtctggctgttgaaagcggctacttagagctgatgtccggtattttgttgcaagagctgaagaacttacctggggatgcaagaactcacctgggatttattgcttatgattccgccctacatttctactccctgccagaagggataactcaaccacaagaaatgactgttctagatattgaagatcccttcattcccactccagacaacttgttgatcaacctgaaagacagaatggatttgatagcagaccttttgaggctactaccttctcgattttctaatacttacgacactaactctgctttaggtgcagccttgcaagtggccttcaagttgatgagctctactgggggtcgtgtcaccgtttttcaagcatcgcttcccaatgtgggtccgggagcgctaactgctaggaaagatccttcgcagagagctactacggaagttgtacacctcaatccggtgaacgatttctataaacgcatagccttggaatgcagcgggcagcaaatagctgtcgacttgtttgttgtcaactctcagtatgtggatgttgcaactatttcggggatcagcaggttcagcggtgggtgcatgcatcattttccactgctcaaaccgacgaagaccatactctgcgagagcttcgccagatgttttaggaggtatttgactaggaagattggtttcgaggctgttatgaggattaggtgcaccaggggactctccattcataccttccatggaaacttctttgtaaggtccacggatttgctgtccctcccaaacatcaatccagatgctggtttcggcatgcaactctcaatcgacgagagcttatccgatgtccagtcggtctgtttccaggcagctctgctgtacacctctagcaaaggtgaacgtaggataagggtgcatacgatgtgtctacctgtcgcttcagtgttgaacgacatcatacactcagctgatcaagagtgcatcgtcgggttgctctccaaaatggccgtggataggtcgatgcagtctagtctctcggatgctcgggaagctttcataaacgtagcaatagatatattaacgagttacaaaatatccctcaacatggcgagctctgtatcaggtcttttggcgccgaactgtttgaagttgctgcccttgtacatatcggcactcctgaagcatcccgccttcaggatgggaggtgccactagggtagatgatagggtcatgtccatgattaacatgaagacgaaacctctgtacttgttgattcagaatatatacccggacttgtacccgatacacgatttggagaatcaggaagtgattttgaactcagaagaggaacccgtttcgatgccgcccagactgcaactgactgctaggtgtcttgagaacaagggggccttcctcatggacacaggcgagcatatggtgattttagtgtgtccgaacgtttcgcaggagtttttatcggaagcgctaggagtcagtaattataacagtatccctgacgacatgtacgaattgccaattttagataaccttcggaatcaaagactgcaccaatttgttaattatctgaatgacgataagccttactcagctacgttgcaagtgattagggacaataatagttgtagagttgtgtttttcgaacggttgatagaagatcgtgttgaaaacgctttgtcttatcatgagtttttgcaacatttgaagacccaagtgaaatagatttaagtgtaccctggttttctgaatattattcaacaatgcaaaagtattgctaggaaattttttatgtaataaaatgaatggaattatgtttggaactgatatgatttcaaggtcaacccaattacacagatagtattcaatgaaaataatctcattgtaatgggagataagatatatggaagattctggttcaaaaggaaacctcaataatagtagataagactgaaccttcacgtgaatgaatttcaaggttggaatgattcagcagaatcatttgaaaatgcggttttaatgctaatttataagaaatggctgtaattcaaatattggatgaaataaaggcatatttagtcaaaatggaagtaatgcaaatattgtttagtttagaaaatatttttgttgaattatataaattactttgctatagaaagtgaaacttaaaggttgaacattattatttaggaactaatttggaattggatcagtaaaaattgttagatatttttttattgaagaaatttggatttgaataaatacatcctcagggctgtaaaatgagaaaaagttcttgactgtaggttttacctacaactctatattgcataactttattatgatatgaaaagtatttttgatcaatgagatgtcaaaaatttaccgaaacatattatttactgtgttgaaaaagattaataactatttgccgtagacagacattaagtaggacaacaatcgaaagtatagtaaataaaaaaacagtagtcaaaaccaaaactggtgtaaaatgaagcatttcaactgaaaagtttaacaaaatgttgaagcaaataacaaaatactaaaaattgttataaaacacgctggcactgaattttgctattgacatttcaatttattgatatttatgatttcatttgtctgtagttgtagctttcattaactttcgttttgtttactacatttttgtttattgtcttttgtttatctgaagttctgcttgcagaaagttcttttcaatatggaaaatcagatgttttgagcgattgtcgttatatgtcaaagtcatgcgatatagaatttcaggtgtaaaatatattcaggaatttttttcctcattgtaataccctgaggataaaaatatttaagtccaaaaggtctgtgacaaacgaggtaatttctctacgaatttttacaaatcctatcccaaactggttcctaatgtcaatctttgaatcactgaaccaaatcagagaatcaattacagaaaaaaaatagccaaattctgggaaaaaaatatgaaagacctttaggtttttttcaggagagggaagatttgaaaatttttgggcattctttgcatatattcagggtgtttcctaggaacctctaaatatttcagaaattgatctaaccttccaaattgaaaaagttcatcagtcactttatcaaatcaggcctcctttatggtacaaatttgaattaaaatatgttgaactagtcctaattttttttaattattgtttacccctcgtatatttaaaatattgaaatacagaattaatgatcctcaaatttatcgaaaacaaatactcttagttgaatttatggggtggttattattatttaaatgaacattatactaccgtatacaaaagttggacagtcgtatacaaaatgccaatgaaatatcttcgaagtttctgaaatgttataaatgctcatttgaattttggaattcagaatttatagaatcagcttctgggaaattttactgctttggaaaaattcggaacacctacttaacatattgttatctcagacatgaattttacttctatagttttcaataaataccaatatcacatcttttttataacactgagctgatatagtattatacacttgtttttcagatcattttattacattattcgaaaattctaatttgtccctttgatactgaaatgtgatatctaatttggcaatatttttgcattaccttgcttttattacgccatcattgattatctattgttttttattgttatcctatagacatatatgttattgtaaaatagatattttaattataatggtcaaagctgtttttttaaactttaattctgtatgaattgccagtttggaatacctttgggttgaaataaactgtatatatatt

SEQ ID NO: 818 - DNA, 4606 bp, Leptinotarsa decemlineata
  Annotation=Protein transport protein sec31A
attgtcaggtgacatcacatcatataaaaatattaggaatatacttttcattatttttgtggacgttgttatgcattatttttacgttatgttaacaatttgatgggtaattcaaaaaaattaatattttatcgtatacagctttaaagcatatagtaaagtgtcgacgtgtccctggttgtagttccaattttgagtctttttgtaatcccgtagctgtcaaaaagaattgaaagccacgttggaagtgcttaccgtgcattcatattcctgttatgaattaattattgatagattgaagtgagactaatctatcaatatgaaagtaaaagatatagaaagaactgccaatgtagcttggtctccaaaaagtcaatatcctatttatattgctgctggaaccgcagcacagcaactggatgcttcattcaacactaacgcagccttagaagtctattcattgagtctctctgacccagggccagatactcaacttgtttcttctattcctagtgaccatcgattccataaaataatttggggatcctgtgataatgaacccagtggtacaatagttggaggatgtgatggtggattaattcaaatatatagtgcttcaaaattattgaagggtgaagatgccattgttggaaagcaagaaaaacatacggggccagtccatgcaatggatttcaataattttcaaaagaatttgtttgctacaggagctggagattcggaaatttttatttgggatttgaataatactagtactcccatgtcgccaggagcaaaaagtcagcctcacgaagatgtcctatcagtgtcatggaataaacaagttcagcacatcttggcttccacatatccatcaaaatgtgttatctgggatctaagaaaaaatgaaccaattatcaaactcactgatacggtttcacgaatcagatggaaagttgttgcttggcatcctgacgttgctacacaactttgtcttgcatcagaagaggaccagtcaccaataatccaactatgggatctcagatttgctacatctcctctcaaaacccttcaagaccaccaaagaggtgttctttcactatcttggtgttcagaagaccctgatttactggtttcatgtggcaaagacaatcgtatactttgttggaatcctaattccaatcaacaaaatggagaggtgctagcagaggtagctagaactaaccagtggagtttcgatgtcgtatggtgccccaggaatccagctctaatagcgtctcctaattttgatggacatgtttcaatatattctttgatgggtggaaaaactcagcaaattcaaactacaaataaaatagcagacagttttcctggaatggaaggatatgtccaggcaccagttcctcaacaaaatactgctcctgtcagcgttgacttgagtaaacctcccagatggttgaagagaccggttagagccagttttgggttcgggggaaaactcattacttttgaaaatgataaggaagcaattgctcaagcctttcaaaatgtccaagcaggccaacctccagcggtaattcacagaactgttcaaataagtcaggttattactgaggccgaacttgtcaagaagtcagtagaactagaaaaggcattagaatatggcaatttcacagactactgtctggcaaaatcagaagatatgaatgatcagcacaaaaggtacatatggtattttctcaaggctaattttgaagatagtcctaggagagagcttctcaatttgttgggatatagtatcgaagacattaacaataaattgaatcagtatgtaacgaaagatgagcagaatattgtggatggattaacaaatgattttgataatttaaataggatagaaaattttgcagccactgatgtttcaagttccacacctctgcaaaaagatacaaaaaagactgaactattcaaaataaaaacaaatgacgacactgaaggccttataacacaagcactgttgatgaataacgttgaagctgcagtcgaactctgtttgcaggcaaaacgttttgctgacgctcttataatatcagcaacaggaggtcctgatttgctggcaagaacccaactcaaatacttggaacagaccaacgactatgtctcctccctgatatctgcaatcgtttccgaagattggagttccataatcaataattgcgaagtgagcagttggaaagaggcccttgctgctgttttaacacatgctactgatgatgatctcccagttctttgcgaattattgggcaagaggttggaagaagaaagtaaaaatgatccaaaattgtcggaggatgctcaactctgttacatttgtgctggcagctttgaaaaacttgtttcgagttggagtgaaaatgcaatgcaatcaacaagtagccttcaggagttgatagagttggtgacgtttttacaaaaagccattgaaagacaagggaggcaagtacaggtctcaggtgctttagcagatctactttctcattacgcttcccttctggcatcccaaggaagcctcaccaccgctatcaactatctaggttcttctaacaacgagaaggttgcgtctctgagagaccgcctttatgtagcccttggtcagaagccagtgaatgttcaggaagtacgacagcagcaaagtagaagaagtagtcatagacaatctttctccagtcaaataacgaacgcattcaacaacacaaacccatttcacagtgcccaacaacagttcggtcaaccaggacaaactgcggtaaatcaagctcctcattttggacaaaaccagttcaatacagggcttcctaattcgggtttgaataatcaaccttggcagactcaagctgttgcgtctgctggtacttatactcagccaccaaaacccttttcaccagcacctcaagtaccaccaccaagtcatccccctagacctactagcgtaggatcttcccatgtggctctgctgggttaccatcaagaaaatatgttcttgacccatcagtttcttctaactcatatggacaaatagcaaaccagtttcctccacaacctgtgaattcttaccaaaataacacctttgccaacaattcatacactcaacctccaatcgttcctagttctaccccaggcagtcaaatattcaatcctctcctgccaagtaattcagcagttgtcaatccaacattcaaccccactccaatagatcccaactcgacaccaatgatgccagtgcaaggttttggtgggtcttcgttaccgccacctccaaccgcagaaattgcacaaccaagttggaatactttctcagcgccatctggctggaatgatcctcctcctattagccgaccacctaagccgcaggccaagccggacttacctgtaaatgaacctatcactcatccaatttacggctctgctcctacgcaaccgcttcctatcaatggttatgaaaatgttgcccctgggcaacctttcaatccttcagttcatcctcaaaatcccccaaccgtatttcagcctcaaccggttctgaacaacttcacctctcctggtttcaaccctggcaatttcaatcaaaatgcagtccaaagcgtcgcccagcagcttcaaaatgtgtccggtacagtgagacctgaaaagcctcaacctattgaaaagggtcccattccagaggaacatatccacatgaagacggtttttgatgaattgagagatcagtgcagccgtactgctaacaatccgcaaacaagaagaaaattggaggacgtaggtcgaaaactggaagcattatatgattcgctaagagaatacaagctatccgccaacacgttaggctctcttcatgaaatggttcaactagttcaaaatggcgactacgcagggggaatgaatttacatactcagttagtttctggtccagactttgctcaaatagccagttttatgccaggactgaaagtattattacaatgtgcttcacagttacaagtgtatttaagatagaaaatattttgtaattagtatttcattcaaggtgcaaacagtgtaataacagcgaactaacatgattccatagaagacctgctgcaattgtattagataagaaagattttttttgtgtcaaagattaaatcgtttatttttatggtcaaaacgaaactacaggtatacatgtatttaagagaattaaatatattaaatgaatctgaattcacttataatctaatagaatttcacagaaatatgagactataaaaggtgttttattttctgcagtaatattttactcgatattacaaattaatcttaaaattgcagaatatttcaatcttcagcttcaaaagataatttttactttcaatattgttggtatataattttatgactatgttatatattttatcgttctgtcaactgaatacttggcttgttatgaatgtttaattttccattcaaatttccagataataatgagattgtgaacatatattgaaagtttataaggtgctttctaataaaaagttgataaaaagaaaaaaaaaaaaaaaaaaaaaaaaaa

SEQ ID NO: 819 - DNA, 1634 bp, Leptinotarsa decemlineata
  Annotation=GTP-binding protein SAR1B
actgtcaaccataagtaacagaactgttactatcaaattaaaaaactcttaaaataataattgggcgattttaaagacttttctgtagtgaatatcaactttacatattttttgtgggataattggtcgtttccaacgttagttcaaattacaaaaatgttcatctgggattggtttaccggtgtacttggttacttgggattatggaagaaatcaggcaagctgcttttcctaggtctggacaatgctggaaaaacaactttactgcatatgctcaaagatgataggctggcacagcatcttcccactttacatcctacatcagaagaattgtcaatcggcagcatgaggttcacgacttttgatttgggaggccattcacaagcaaggcgagtgtggaaggactacttccctgctgttgacgccattgtctttttagtagatgccaatgataggaacagattcaaagagagtaaacaagaattggattcgctactcacagacgagactctttcgaattgtccggttcttatattaggtaacaaaattgatttgcctcaagcagcttcggaagacgaactaagaaattactatgccttgtatggccaaacaactggaaagggaaaggtggcaaggtccgatttgccaggacgtcccctcgagctcttcatgtgctccattctgaagaggcagggatacggagaaggtttccgttggctggcccagtacatcgactgaagtttttttgtgcgagtggattcgttaaggtgtacctacacggtattctttcatgaacaaggtttttctatatcaattcatatgtgaccttttttttttcggtataattggttttttatcgtgtagtatatataaaaaaatagttttaatagttgaattatacaattttttagctgcgtcgccgggcaggccaaacgttttgtgtgattgcttttgcagttttgaagactcggatcgtggtcgcctactgaatgaaatattgagagttttttgaagaggtttttcatgttttcggggctgcatttgtctcttttaacgaaatgtttggccttgctaaccaatgcagtttccgatttgaattcgatcgtattccacttttgataaatactttagtgaaatttgaaaatgtgactaacttgtttgaattatttatgtatttattgtggtgaaaattgattttccacttcaaaattgaaacgtgtatttctgtagttccttatttgtagacaaatatttttttcgttgattatttccttggagctcgaagagaactgtgttttgttttgatggaaaaagttgatttttgcttagttcaagcaccaatttgacattatatcaacacagaactcttcagagatgatattatttttccattatgtccgtataaatggactgtattatatttataatatgatcttcggaaaaacctttttgtaagttcttggattgttcgaaaattgataccagggaaagttcaacttggaaatttacttattagtttccgcccagttgagaaatcacgatgcatattcataaactcacgagattttttaatttgtaagtgatgttggtcattgttttttaaaattttctttgttgaataaaactgctttgta

SEQ ID NO: 820 - DNA, 1547 bp, Leptinotarsa decemlineata
  Annotation=Protein transport protein sec13
ggaagttgtggttagggttccatattttcaagattttttcaaaaaaaaactatacttattagtaattaataacatggtttcaatattaaattctatcgacacaggccatgaagatatgatacacgatgctgaagtggattattacggtttgcgtttagccacttgttcatcagataacagtgttaaagtatatgatataaaaaatggggcctcaacccttttagatgatttaaaaggacacttcggtcccgtttggcaaatagcgtggagccatccaaaatacggcaatctcctagcatcttgttcctatgatagaaaagtgataatatggaaagaacaacagaggaagtggtcaaaatactatgaatatgcaaatcatgattctagtgtcaactctgttcaattcgcccctgcagaattagggctcattcttgcatgtggcagcagtgatgggtccatatccattttaacttacaatgctggtagtaataattgggatgcaaaaaagattcagaatgctcatgcaattggatgcaatgctgttagttggtcaccggcaataacgccaatatttggaaatgctgagaccgatcaacaatcgcaacctgtcaagaggctggtttctggaggttgtgataacctaataaaaatttggaaagaagatggtgataggtgggtagaagaatcaaaattagaagtacattccgactgggttagggatgtggcttgggctccctcagtaggcctccacagatttatcatagcaagttgctcccaagatcgaagagtagtcatctggaccagtaatgattgtatcaactggaattctactgttctccatacatttgacgatgttgtatggaatgtcagttggtctttgaatggaaatattctggcagtgtctggtggagataataaaatcaccttgtgggatcaaaacactgaaggagtttggcagtgcataagtgatgtagctaagggccagggacagatcaataatcaataattatgaggcaaaaaaactacaattttattatggatatactgaaattccccaggattgttgtttattctagttctagaatctttttcttattttaaaattcaacatgttttcaaagttatacttgagatttttcaaataataaattgatggatgtagccgttactatgtggtaggagattataatgaagaaaagagaattgaaactttctatgtaactaacgttacagcagttttgttagtttcaaatacgttagttacaagtaaaagtggtaaaaaacatagaaagtttcaattttcttttcttgattatttttcaaatacaacgtaaaggggaattcataccaggcttggactgattcaaatcaagcgttctttatcattgatttaatgaaaaatatatttttgttcaatttggacaaaaattgaaattattaactactgaactaactgtcgaataaatctgatgattctaaaaaagttgagtaatttttaacaaaaaaacatgtatatttgaaggttcaaccaaaagaataaaaaatag

SEQ ID NO: 821 - DNA, 563 bp, Leptinotarsa decemlineata
  Annotation=Actin
ccaccactgctgaaagagaaatcgtccgagacatcaaagaaaagctctgctatgtagctcttgattttgaacaggaaatggctacagccgcaagttccagctcccttgagaagagctatgaacttcccgatggacaagtcatcaccattggtaacgaaaggttccgttgcccagaagctctcttccaaccatcgttcttgggtatggaagcaaatggtatccatgaaaccacttacaactcaatcatgaagtgtgacgtggacatccgtaaggacttgtacgccaacacagtattgtctggaggtaccaccatgtacccaggaattgccgacaggatgcagaaagaaattactgctttggctccaagcacaatgaaaatcaagatcattgccccaccagaaaggaaatactccgtatggattggaggatccatccttgcttcactttccactttccagcagatgtggatctccaaacaagaatacgacgagtctggtccatctatcgtccacaggaagtgcttctaaatttttttcgccagcattctattgtatgtttcacat

SEQ ID NO: 822 - DNA, 2055 bp, Leptinotarsa decemlineata
  Annotation=Coatomer subunit beta
gataagtatgaattatgacttttatctgacacgtacaagccgatattattttataaagtgaaatactttaaaatacaccttcgacaatctacacagtgtttatggatgtgaaacatagtttttcagctctttaactacaaatagtgtgatagtggaattcttcaattgtacgtgttttttaaagtaatctgaaaatgactaccatggaacagccttgttacacactcatcaattttccgacagattctgaaccatataatgaaatgcaactcaaaacggatttagagaagggcgatgtgaaagtcaaaatacgagccttagaaagaaccattcacatgattttggcaggagaacgcctgccgaacggtttcttaatgacgattatcaggtatgttctgccgattcaggatcatttggccaaaaagctgttgttaattttttgggaaattgtgccaaagacctcacctgacggaaaactgctacaggaaatgattctcgtttgtgatgcatatcggaaagacttacaacatcccaatgaattcctcagggggtcaacgctgaggtttctttgcaaacttaaggagcctgagttgttggagcctctgatgccaagcatccggaaatgtttggagcacaaacacagttatgtgaggagaaatgctgttttagccatattcaccatttatcgcaattttgaatttcttatacctgatgctcctgagctgatttccaactatctcgatggagaacaagacatgtcatgcaaacgcaatgcttttctcatgcttctacatgcagatcaggagagggctttgtcgtatttagcgtcttgcctggaccaagttacttcgttcggtgacatcttacagttggtaattgtggagttaatatacaaagtctgtcacacaaatccctcagaacgttcccgattcatcagatgcatttataacttgctgaattccagtagtcctgcggttcgttacgaagccgcagggactctggtaactctatccagtgccccaacggccatcaaagctgccgccagctgttacatcgaactcatcatcaaagaaagtgataacaacgtgaaactcattgttctggacagactgattgcgttgaaagatcaccccagtcacgagcgagtcttgcaagacctcgttatggacatattaagggttctctcagccccggatttggaggtacgcaagaagactcttagtttagccatggagttgatttcgtcacgtaatattgaagagatggtactgattttaaagaaagaggtctctaaaacgcttgacagtgaacacgaagacacaggaaagtaccgtcagttattagttcgcacgttgcattcctgctgtatcaaatttccagatgtggccgttaccgtaattccagtgttgatggagtttttgtccgacagtaatgaattggcagccactgacgtacttgtgtttgtgagagaggccgtacagaagtttgagaatttgcagcctctagttatagagaaattattggaaactttcaaggatatcaaatctgtaaaggttcaccgtgcagccctttggatattgggagaatatgctacctctgttagtgatatagagatggtaatcaagcaaattaatcaaactttgggtgattgccccctcttggaagcggagcagagactcgtttctggagatgcagaggaaaatatttcaaacataagtagtaccactacaacgttggttacatctgatgggacttacgctacccagtcatctttcaatacagttcacaaatcaagtaaagaaaagaggcctccacttcgtcaatatttaatggacggcgatttctttattggagcctcgctcgcttccacattgacaaaattagctttgcgctacggaaatctcacttctccctcacaaaggaatagatttgacactgaagtcatgttgatcatggcaggaattgttcatttgggaaaatcaggcttgccaacgaaaccgatcacgaatgacgataaggatcacatcctgttctgtctgagggttctctccgatc

SEQ ID NO: 823 - DNA, 2735 bp, Leptinotarsa decemlineata
  Annotation=Myosin VIIa
atcgatatggtgacaaattttattgataagaaacgccaacttgatgtttgccaaatccataatttcatgtagttctttcaaactgtgcaaaataaaatagtgttaagtataatggcacaaaatccaatattgggtgattacatctgggcgaaacccctaatggaaagtgaattcaacattccaattggaggaaaaatagttgctattgaatcgaccagaatcaaaattcaagacgatgataatagacagtcgtatatttcgaaccggcaaattctcaaaaaaatgcatatctcttctatcaaaggggttgaagatatgatcaatttgggagaactggaagaatacgctatcctcaggaatttacataagagatacaacgaaaaactgatatacacatatacaggttctatgttagtagcgataaatccttatgaaattctgccaatatacaccaactttctcgtcaaagagtacaaaaacaaaaaaaaggaggaaaagcctccccatatttttgcaattggagacaatagctacacgaacatgatgaccactaaaaaggatcaatgtatagtcatcagtggagagagtggggcaggaaaaacagaaagtacgaaacttattcttcagtacctcgcttcaacgagcgctcagcatacttggatagagcaacaaattttggaagcgaatcccatcttagaagcattcggtaacgctaaaaccgtcagaaacgacaattcttcccggttcggaaagtatatcgatatccgattcaacaaagcgggaaacatagagggcgcccatatcgatcagtaccttttggagaaaagtagacttgttttccaaagtgacggtgatcgtaactatcatattttttatagcatgctggctggtatgagcaaagaagaaaagaaacgattagatttgggagacgccgagtcatatacctatcttaaaggcggaagaactctagtttgccaaggaagaaatgaacaaaaagaattttcggacatcacggcagcatttaaagtgctcaacttcaccgaaacggaaatcaccgacattttctctttgctggcagcaattctacatctgggcaacctcagattcaaaagcggtaccgtcaaccactccgacagttccgagataggcgatgtccacctcaacgagaaaattgccagactactagaagtgaacaagtttgatctcggagaatccctcacaaaaaaaaaccttgtatgcccacggagataaggtggtggcaaatttatcaaaagatcaagccggggaatctcggaatgccttcgtgaaaggtatatacgggcaacttttcatttttattgtcgacaaagtcaatggagtaatttcatccaagaagctacaatcaaaatcgtcaataggcgtgctggatattttcggattcgaaaatttttcaatcaacagtttcgaacaagtttgcataaattataccaatgaaagtctccagcagtttttcatcaaccatatcttcaagttggagcaggaatactacaccaaagaaggaataaactggtccaatataacgttcatcgataaccaggatatcttggatctgctgggaatgaaaccgttgaacgttctttcgttgatcgatgaagaatccaagtttccgaaaggcacggacttttccttattgtccaagttacataaacaacacgaaaaacacgcaaagtacatcaaattgaaaaatgatattacgccctcgtttggaattcgtcatttcgccggggacgtttattacgatataccaggatttcttgagaaaaaccgcgatacgttcagtcaagacttgaaaaatctggtgattggatctcgaaacaaccttcttaaaaatctcttcaaaggcgaacttgactctgcattgaaaaaaacactatcagctcagttcaaaatgtccttagaccagctcttgaaaactctagggtcctgccatccttatttcgtaaggtgcatcaagcccaataacgaaaaaaaccccaaatattcgacagaagcctatgcacaagacagctgcgctattccggcatgatggaaactgcaaaaatccgaaaggcagggtatcccatccggtacacgtacatcgagtttgtcgacacgtttcggttcttggcaagtaacattccgccatcagccaaaggcgactgcaaggcttccgccacgaaaattctagccaaggcatttcgcgacgtagagcagaagaactatcagctcggacatacgaaggtgttcctcaaacacaacgacaacgacattctagaagagctacgcaacaaaatactggagcaagccgtgagcactttgcagagggtggtcaaaggctgggtgcacaggagacgattcctgaagaagcgggcggccgctatagtcttgcagaagcactttagggccagaggctacagaaagagatacctaatgatgcgcaacgggttccaacgtctgcaatccgtgatcatttccaggcagctcgcgcacgcctatcaaaaaattcgaaagaacatcgtatctattcaggctagcagtcggggatatatagttagaaaacacagtcagtttgggaacattttcgctattgtcaagcagaggaagagtgaagaggcagagctgatgaagcgtggtcataaaaattacaaggctgaggctgagactgcgatgcagcagaagcttgcaaattatcaccggaaccaagaaaatgtaagcga

SEQ ID NO: 824 - DNA, 3294 bp, Leptinotarsa decemlineata
  Annotation=Myosin VIIa
ctgataaacatgactctgaagagaaaaaataaattgcttgaagacgtcaggaaaggcttggtagaagacacttttgccctggataaatacaatgaatggttacacaagagacgaacaaacaacttggaaaaattacactttatcattggccacggcattttgcgtccggaactaagagacgaaattctggcaatgatctgcaaacaactcaccaataactatatcaaatcttcatacgcgagaggttggatactcctctcactttgtgtgggctgcttttctccatcggaaaagttcataaactatctgagatcctttataagatctggtcctccaggatatgctccatactgtgaagggaggttgaatcgaacgcaccaaaacggggttagaacacagcccccaagctggttggaactcatggccaccaagaataaggctcctatgcacctcgaagtcactctcatggacggtaccagtcaaatagtggaggttgattcggctacaacttcagaagaacttctcgcacaaataagtaccactcttaatctaaaggatgtcttcggattttctctattcgtaactttgtatgacaaggtaatgtctttgggaagcgagagtgataatattatggatgccatttctcaatgtgagcaatatgccaaagaacagggacaagaagagagaaactgtccgtggcgcctcttcctacgcaaggaaatcttcactccttggcacgatccttcggaagattccgtcgctaccaacttgatctaccatcagatagtaagaggtttgaaagcaggtgaatatcggtgcaacaacgaagcagacgtggtcgtactgatcgcgactcagtacttcgtggataacggaccccaattcaacaagaacgttctccatactcgcatcggagaatacatgccgacctacttggtcaaagcgagtcagagcgacttgtccgattgggagaccaaaatcatgaacgccttctccaacctagccttcgtcaaacaaaacttgccagcgatcactgcaaaggaggcagtggtaaaatacgcgcagtcgacgtggccgatacttttttccaaattttacgaggcgatccaggtgtctgggccggaacttcctaaaaaggacatgatcattgctgtgaacggaagtggaattttcatgatcgacgatcaagagcagatactgctagaactgatgtttgcagatgtttcctatgcgacttacgaagttacgcccgagctacggttcgtttttcatacggtggccaaggaggagtacaccttttatactttggacgcgaagagcatatccactttggtgcaatatatcgtcgatggactgaagaagaggtcggtctactgtgtcgcaacgcaagatcactctcatcctacaggggcagaatcattcttgtctttccgcaaaggtgatctgatcgttctccagaacgacttcgacggagaaaaactgatgaattccacctggggatacggagaaagtaatggcaaagtcggagactttccaactgaaaacgtctacattatacccacgttgcagtgtccccctgccgacattcttaaatgcttcaaaaaagaaggtatagtaatcggaaagccccacaagacgatagtcaccacgttgcaaagaatgaagctatacaccttggcgagctacgccacggatcacttcagagagggtaaaatacgaactgttaacaagacatcagtgttaacgactgcgagaaaaatgtcaaaagaagacctctggaaatactccaacgaaccgatataccaacctctattgcagagcgttctggcagacgaaaccgccagtaaagaagcgtgcaatatatacaccgccatcctcaagtatatgggcgatctgccagctccaaaatccaaatacagcaacgaatacacggacatcatcttcggagggcctttgaggaatgagttgctcaaagatgaggtgtactgccagattatgaagcaacttacgttcaataggctttccttgagtgaagaaagagggtgggaattgatgtatctaatcacagggctgtattcgccaagtgagaaattgaacgtggagcttcagaagttcttaaaatcgagaactcatccattcgtggagcattgtttgcttagactgcagaagactcaaaaagttgggccaaggaagttcgccccatactccatcgaagtggatgccattcaacacaagagcatggaaatatatcacaaaattcatttcccagacgacacggatgaagcatttgaagttgactctatgagccgagccacagacctttgcaaagccatagccgcaagattagagttgcaatccacggacggtttcagtctgtttgttgccatcgccgacaaggtattctcggttccccaacagacgtttttctatgatttcctaagcgaactgatcgattggagacggcagttgcatccgaactggggaaagactgtagtcgatattcattaccaagtcttctttatgaagaagctctgggtgaacacggtgccagagaaggaccacaatgccgaccaaatatttcattatcatcaagaagtgcctaagtacctgaaaggataccacaagtgtagcaaacaggatgcagtcaaacttgcggcccttattcttagagccaagtttgaagacaatgtttctgacgttcagtctgctctacaacatgacttgaaggattgcattccctgtgatatcgtaaaagctgccagttcttcggagtggaggaaaactattttggcggaatacaggaatttgagaatcaacggagagcaatcgaagacacaatttttgaagaccactttcaaatggcccacgttcggatctacgttctttgaggtgaaacagtccaccgaaccaacttatcctgaggttatcctgatagccatcaacaaacacggagtcaatattatacatccgcagaccaaagatattttggccatccatgagtactctgagctgagtaattggtcatcaggggttacctactttcatctaaccataggaaacataatgagaaaaacgaaacttttatgcgaaacctctcaaggttacaagatggacgatttaatcacttcatataccgattatattagacttgaacaagccaaataattgtactagatgtttcactgtagaataagtttataacaaataaattatgtttagctcgtttaatttatggtttcaatgtaagcaccgtgataactgtaaaacaaaataaatcgaattgttgttctgccg

SEQ ID NO: 825 - DNA, 1838 bp, Leptinotarsa decemlineata
  Annotation=26S proteasome non-ATPase regulatory subunit 1
ggtgtgttgtgtgctgtgtatcaaacatcagaatcagaatctgatgatcacatcagtcagtttactagaaatcttgttaaggttatagttaatattttgtggttatcgtatccaagtgtttgaaaatatgttaatccaaatgaatattacatctgcagcggggattatttcccttttggaagaacccaaatcggaacttaaagtattcgctttgaaaaagctcgacacaatagttgatgagttctggccagagatctctgaagctatagaaaaaattgaaatactgcatgaagacaaagtatttccgcaccatcagttagctgctttggtagccagtaaagtttactaccacctgggagcatttgaagactctctcacgtatgcattaggtgctggagatctttttgatgtcaatgcccgtactgaatatgtggaaacaattttggcaaaatgcattgactattacactcagcatcgtatcgctcttgctgaaggagttccagatgccaaaccaattgatcccagactagaagcaattgtaaatcgtatgtttcaacgttgtttggatgacggtcaatatcgccaggctatgggtctcgctcttgaaaccagaagaatggacatctttaaggcatccatcaagcagtcagacgatatgatcagcatgcttacctatgcttttcaggttgccatgagtctcatccagaatcgcagttttcgtaatactgtcctaagagctttagttggtttgtacagtagcttggcttctcctgactatgtgaacatgtgccagtgtctcatatttcttgaagatccccccaccgttggaacaatcctggacaaacttgtcttgggagatgaggacagccaactgatggcctatcagattgcttttgatctgtacgagtcggctacccagcaatttttgtcgcaggtgctcttctctgttaggaacactgcaccgattccatcgttgctagaagagaaaatcaagcccaaggtggtcaagagtcagactgctacgactgctaatgcggatggggctgaagctgctgaggaagcacctaaagtagaagaaaaaccagaactgacaatggatgacttgagtgacagtgagaaagaacaccagttgcgacttgaaaaactccacagcattctctctggacaagtttccattgaacttcaccttcagttcctcatcagatccaatcatgctgatttattgattttgaaacaaaccaaagaaacagttcgagttagtatttgccacacagccactgttattgccaatgcattcatgcatagcggcacgacaagtgaccagtttctgagagataatttggaatggttagctcgagccacgaactgggccaagttaacagcaacagcatctttgggtgtaatacacaggggacacgagcaggaagcgttaaccttaatgcaaagttatcttcccaaagaagtaggacctagttcggggtattcggaaggtggtggtttgtatgctctaggacttatccacgctaatcatggtgggaacattattgattacctgctgggtcaggtgaaggattcgcaaaatgagatggtgaaacatggcggctgccttggcctaggtctagctgcgatgggcactcacagaactgatgtttatgaccagctaaagttcaacctttatcaggatgatgctaatacaggggaggctgctggtatagctatgggtatggttatgttgggctccaggaataatcttaccatcttcgatatggtggcgtatgcccaagagagccaacacgaaaaaatactccgcggtctcgccgtcggcatcagtttcacga

SEQ ID NO: 826 - DNA, 615 bp, Leptinotarsa decemlineata
  Annotation=26S proteasome non-ATPase regulatory subunit 1
cgacggacgacaagaaagcagaagacaagaaaccaagcagctccacttctgaggacaaaaaagaaaagaaggatgaaaaagacgagaagaagaaggagcctgaaccaagtttcgaaattctgcaaaatcctgcgagggtaatgaggcagcaactgaaggttctttcgataaatgatagtagccagtacgcacccgcgaaggaagtatccatcggtggcataatcatggttcgcaatctcaagcctggagatgaagaacttgttgagcccgttgcagctttcggaccgaaaggtgaggacgagaaagaacctgaaccaccagagccattcgaatggactgaggaataaattaatactaatactgtagcatcctctttcattgacgcttctttacacagtccactttcccattatattattagccattagaaatataatatggatgtatctaagtagtttttctgttataagctatttattaacctgggaaatatagtcccagtcatttattgtcacatatgtaatcaccatcttgatgtttcaataaagaataagatactaaaaaaaaaaaaaaaaaaaaaaagtaactctagacgttagaataaccaactagact

SEQ ID NO: 827 - DNA, 335 bp, Leptinotarsa decemlineata
  Annotation=Putative uncharacterized protein
ggggggacaaatttattctattcctatcggagggatgtgtgttaggcaagcggtttctattggaggttcaggttccagttatgtttatggttatgtagatgctaatttcaaacccaagatgtcaaaggaggaatgtgcgaaatttgtcacaaatactctggctcttgcaatgtctagagatggatcatctggaggtgttatccgtctaggtataattacggaggcgggaattgaacgtcgtgtcatcttaggcgatgatctacccaagttctatgaaggatagagcatataataatcataatttttcattttgtaattggtgtcaataaatcaaa

SEQ ID NO: 828 - DNA, 2526 bp, Leptinotarsa decemlineata
  Annotation=coatomer subunit gamma
acaaccgggtgattgtgtcaactatcggtgtcaacgattgtgacgtgtaaattttctaatatacaaataaatatttctggattttatttgaatttttgatatatttgtcaaatcaaaatgagttcctttaaaagagataaaaaggaggaagaagatggaggtggcaatccatttcaaaacatcgagaaaactactgtgctccaagaagctagagtattcaacgaaacttctgtcaatcccagaaaatgtacaccaattctcaccaaattgttatatttattgaaccagggggaatctctcagtgttcaggaagccacagatgttttctttgcaatgacaaagctatttcagtcgaaagatgtaattctcaggcgcatggtatacctggggatcaaagaactaagctctgtcgcggatgatgttataatcgtaacgtcaagcctacaaaagacatgactgggttgtcaggaaaagaggacatgtacagggctgctgcaatcagagctctttgtagcataactgactctacaatgctgcaggctattgaaagatacatgaaacaagcaatcgttgatcgtaactcagcagtaagctctgctgctcttgtaagttccctacatatgaccaaattggcttcagaagtggttaaacgttgggttaatgaagcacaggaagcaatcagaagtgataacatcatggtgcagtaccatgctcttggtctactatatcatataaggaaaactgaccgattagcagttactaagctaattgcaaaattgacaaaaatgtctctccgatccccttatgctgtttgtatgttgattcgaataaccgcaaaacttctggaggaagaagattccccttactttgaattcattgaatcctgcctgaggcacaaatcagaaatggtagtgtacgaagcagcacacgctattgtcaacttgaaacgcaccacaagcagggaattggctccagctataagtgttcttcaactcttctgtggttcccccaaaccgacactgagatttgcagcagtccgaacgctcaatcaggttgcgatttcacatcctgctgcagtaactgcttgcaatttggatttggagaatctcataactgattctaataggtccattgccacactagccattacaacactcttgaaaacaggtgctgaatcctcagttgatcgcctaatgaaacaaattgcaacattcgtgtccgaaatcagcgacgaattcaaagtggttgtagtccaagctatcagggcattagctttgaaattcccgcgaaaacatactgttctcatgaacttcttatcagctatgttgcgcgacgaaggcggtttggagtacaaagcatcaattgctgacactattataacaattatcgaagataatcctgaagctaaagaaacaggattagcacatctctgcgagtttatagaagattgcgaacacgtttcactggctgtcaggattttgcatttgctcgggaaagaggggccgaaaacaaagcagccttcaagatatatccgtttcatctataatcgagtcatcctggaatgtccttctattagagctgctgcagtatcagctatggcacaatttggggcatcttgtccagatttgttggagaacattcaagtcttattagctcgctgtcagatggattctgatgatgaagtccgtgatcgggctacttattacagcagtattttgagcagaagtgataaaagcctttacaataattatattttggaaactttacagatttccattccatctctggaaagatcattgaaagaatacactcagaatgcatcagatcaaccatttgacatcaaatcagtaccacttgcttctattccaactactgaggagcgtgaagtcaaacacagagctgagggtatgcttgtgtctcagggccccgcaagaccagttccagtctcgcgagaagaaaactttaccgaaaaactcagcgctataccaggaatacagcaattgggccccttgttccgcagctcagaagtcgtggaactgaccgaatcagaaacagaatacttcgtccgatgtatcaagcactgcttcactcaccacgttgttctgcaatttgattgtttgaacaccctaagtgatcagctactggagaatgtcagggtggagttggagccgagcgagatgttcgagattatttcggaagttccttgccccaagctcccttataacgagtctggtaccacttatgtagtgttgaagttccccgacgatgacctagctgcttgcgttggcactttcggggcagtcctcaagttcgttgtgaaagattgcgatcctacgactgggttaccggattccgatgaaggctacgacgatgaatacatgttagaagacctggaaatcacactcgaagatcagatccagagggtcagcaaagtcaactggggtgcggcatgggaagaagcagcagccaccttcgtggaaaaggaagacacttattccttgagctctatgaatactctggaggaag

SEQ ID NO: 829 - DNA, 1514 bp, Leptinotarsa decemlineata
  Annotation=crooked neck
agctatgctgtgaccttgtcagcctatagtatgaggtataaaatagtaaacatttgtttattattctgtatatgaggctcaacagagaaacaagaagtttaaacagccacaataaaaaaagcttttgtataaagaagtgaatcatggaaaacagaccccagaaaatgcccaaggtggcgaaggtcaaaaataaagcccctgcagaaattcaaatcactgctgaacaattgttaagagaagctaaagagagagatttggaaattctcccacccccaccaaagcagaaaatttctgatcctgctgagcttgcagattatcagttgcgaagacggaaacagttcgaagacaacataagaaaaaatagaaccaacatatctaactggatgaaatatgcacgatgggaggaatctcagaaagacatacaacgtgcaagatcagtttgggagagagctttagacgtggatcaccagagagtcccaatatggttaaaatatacagaaatggaaatgagaaatcggcaggtaaaccatgcaagaaatttgtgggatcgagctgttacgatattacctaggattgatactttttggtacaaatacacttatatggaggaaatgttggaaaatgtacctggagcccgtgctgtctttgaacgatggatggagtggcagcctgatgagcaggcatggcaaacttacatcaattttgaacttcggtataaagaaattgatagagccagacaaatatatgaaaggtttgttatgactcacccagaagttaaacactggattaagtatgcaaaatttgaggaaaaacatggtttcattcattctgctcgcaaaatctttgaacgtgctgttaatttttttggtgacgatcatttggacgaaaatttgtacattgcttttgctaaattcgaagaaaatcagaaagagcatgaaagagcaagggtaatctacaaatatgcgcttgatcacatacccaaagaccagactaaagaactctataagtcatacacaatacatgaaaaaaaatatggagacaaaagtgacatagatgaggtgattgaatcgaagcgaaaatttcagtacgaacaggaaattttgcaaaatccaactaattacgatgcttggtttgattatattaggttagtagaaggtgaaggagacttagaatttatcagagagacgtatgaaagagccattgccaacatacctccttcaaatcaaaagcaattttggagaagatatatatatctttggataaactatgccttgtttgaagaattagaagccaaggactatgaccgtaccaggcaagtgtataaggcgtgtttagagttactgccccacaaggttttcactttctcaaaaatatggttgctttttgcaaagtttgaaattagacaaaaaaatttaactcctgccagaaaaattcttggaatggctttgggaatgtgtccgagggataagctctttcgcggatacatagatctggagttacaactcagagaattt

SEQ ID NO: 830 - DNA, 821 bp, Leptinotarsa decemlineata
  Annotation=crooked neck
gagacaaaaaattattgatgaagatggcattgaacagggatgggaagaaatttttgattacatttttcctgaagatgaggctaacagacctggtttaaaattcgtggcattggttaaaaattggaaaacaaagtcagctcaagagtcagaggcacaggctgaggaagaaacaagtagacctggagctctgaatgcaagttctgctgctaaagtcgatagcagcgatagagtaagggaaaaattgctgggtctgtcaaacaaatggaaaaaaatcagtagcagtcatgtgaatgattcagaaaatgagacaaatgttgtgtcagaacaaaaaaaggattttgagtccgtaaatgaggaagaaaatacaaaaagtaaaagagaatcagattctgaaaatgatagcaacagttagcaatctcgaagttcatgaaaaaataaaatctagaacatggtacagaaccttattgaatatttatgtatagttacccctttaaaaaaatcaacatcatatatgttactagaaacaatagtgtatcaatgtggttaaattgaaaactgctaatgtgaatgtaaacataagtttaaataaattatttaattttgagtattccttaggttatctataagtattccacgatgctagactgtggtattgactggtcaatcagctcttagctttcaactcaataaatatgttatgttgtataatagtatgtttttagatgtcaatttatgacaaaacaaaataaatcctttaattttcaactgttggtgctgtaattgaattattaaatagaaactagtggaatggagatataaag

SEQ ID NO: 831 - RNA, 127 nt, Artificial sequence
  synthetic construct
guuuuucaagucgcaacugguguucuuucucacugucacucaagucauccauugucaguucugguuuuucuucuacuuuaggugcuuccucagcagcuucagccccauccgcauuagcagucguagc

SEQ ID NO: 832 - RNA, 128 nt, Artificial sequence
  synthetic construct
ggaucuucaagaaauaugagacacuggcacauguucacauagucaggagaagccaagcuacuguacaaaccaacuaaagcucuuaggacaguauuacgaaaacugcgauucuggaugagacucauggc

SEQ ID NO: 833 - RNA, 127 nt, Artificial sequence
  synthetic construct
gccgccauguuucaccaucucauuuugcgaauccuucaccugacccagcagguaaucaauaauguucccaccaugauuagcguggauaaguccuagagcauacaaaccaccaccuuccgaauacccc

SEQ ID NO: 834 - RNA, 130 nt, Artificial sequence
  synthetic construct
gcaccugcgacaaaaauugcuggguagccgacucguacagaucaaaagcaaucugauaggccaucaguuggcuguccucaucucccaagacaaguuuguccaggauuguuccaacgguggggggaucuuc

SEQ ID NO: 835 - RNA, 127 nt, Artificial sequence
  synthetic construct
guugcuguuaacuuggcccaguucguggcucgagcuaaccauuccaaauuaucucucagaaacuggucacuugucgugccgcuaugcaugaaugcauuggcaauaacaguggcuguguggcaaauac

SEQ ID NO: 836 - RNA, 136 nt, Artificial sequence
  synthetic construct
guaauuucuuucugcauccugucggcaauuccuggguacauggugguaccuccagacaauacuguguuggcguacaaguccuuacggauguccacgucacacuucaugauugaguuguaagugguuucauggauac

SEQ ID NO: 837 - RNA, 136 nt, Artificial sequence
  synthetic construct
gcaaggauggauccuccaauccauacggaguauuuccuuucugguggggcaaugaucuugauuuucauugugcuuggagccaaagcaguaauuucuuucugcauccugucggcaauuccuggguacauggugguac

SEQ ID NO: 838 - RNA, 129 nt, Artificial sequence
  synthetic construct
guauuuccuuucugguggggcaaugaucuugauuuucauugugcuuggagccaaagcaguaauuucuuucugcauccugucggcaauuccuggguacauggugguaccuccagacaauacuguguuggc

SEQ ID NO: 839 - RNA, 127 nt, Artificial sequence
  synthetic construct
gaguuguaagugguuucauggauaccauuugcuuccauacccaagaacgaugguuggaagagagcuucugggcaacggaaccuuucguuaccaauggugaugacuuguccaucgggaaguucauagc

SEQ ID NO: 840 - RNA, 127 nt, Artificial sequence
  synthetic construct
gagcuucugggcaacggaaccuuucguuaccaauggugaugacuuguccaucgggaaguucauagcucuucucaagggagcuggaacuugcggcuguagccauuuccuguucaaaaucaagagcuac

SEQ ID NO: 841 - RNA, 132 nt, Artificial sequence
  synthetic construct
guucuuucuaaggcucguauuuugacuuucacaucgcccuucucuaaauccguuuugaguugcauuucauuauaugguucagaaucugucggaaaauugaugaguguguaacaaggcuguuccaugguaguc

SEQ ID NO: 842 - RNA, 125 nt, Artificial sequence
  synthetic construct
gugcgaacuaauaacugacgguacuuuccugugucuucguguucacugucaagcguuuuagagaccucuuucuuuaaaaucaguaccaucucuucaauauuacgugacgaaaucaacuccauggc

SEQ ID NO: 843 - RNA, 131 nt, Artificial sequence
  synthetic construct
gacuuuguauauuaacuccacaauuaccaacuguaagaugucaccgaacgaaguaacuugguccaggcaagacgcuaaauacgacaaagcccucuccugaucugcauguagaagcaugagaaaagcauugc

SEQ ID NO: 844 - RNA, 140 nt, Artificial sequence
  synthetic construct
gucaaaucuauuccuuugugagggagaagugagauuuccguagcgcaaagcuaauuuugucaauguggaagcgagcgaggcuccaauaaagaaaucgccguccauuaaauauugacgaaguggaggccucuuuucuuuac

SEQ ID NO: 845 - RNA, 129 nt, Artificial sequence
  synthetic construct
gauagaguuaccagagucccugcggcuucguaacgaaccgcaggacuacuggaauucagcaaguuauaaaugcaucugaugaaucgggaacguucugagggauuugugugacagacuuuguauauuaac

SEQ ID NO: 846 - RNA, 144 nt, Artificial sequence
  synthetic construct
gcaucuuugauaauuauuuucauccacguauuguucuaguagaucaagucuuucaauuuccaucaguaaaucacaugcuucugcuucagcauugugagccauguuauaaggaaggaucugcuuagccaguaaaauuaauuuauc

SEQ ID NO: 847 - RNA, 128 nt, Artificial sequence
  synthetic construct
guuaaggcuacauauucuucgguggcuaauucagcucuuucaccauaagccaacagaacaggaguagugugaguuuggaaaccaguaauugucuuugguuugccugccugaccaaccacaucaacagc

SEQ ID NO: 848 - RNA, 130 nt, Artificial sequence
  synthetic construct
gaucuuuuucuuuaacaguuuccuuuuuguccuuaucuuuggagcuuuugucggugcuaucagagccuucauaaugcucugaacaaaugugcagcaaauucugaacuuugagaacguuucccguuccagc

SEQ ID NO: 849 - RNA, 134 nt, Artificial sequence
  synthetic construct
gcaauaauaguaucuauaccuuccuguuuucccaaauggcaaagacccagacccaaaggcaaaaaccgagcguauguaucuuucaguucuguaucugauuucuccauuagaguuugcauaauuguuguggugac

SEQ ID NO: 850 - RNA, 127 nt, Artificial sequence
  synthetic construct
guuccucaucaaaugucacaagcauucuagguugcauagccgcugcuaagguauaaagcagauaaugagaucuuccuaauauuauauuuuugacauccaagaauccaauaaguguugccaucaaucc

SEQ ID NO: 851 - RNA, 138 nt, Artificial sequence
  synthetic construct
gaacuuaguauugaucuuuuucgauaugauuuguguacgaauauaguccugcuuggcaagacauagucucauuuguucuagaaucagcucuacuuuuucacguuuuuccauagagccauaaguuucaacuuguaguuc

SEQ ID NO: 852 - RNA, 133 nt, Artificial sequence
  synthetic construct
guuucaacuuguaguuccuguauaauauucgcagccucuucaauauuacccucuucuucgcgaauuuuagcuaacuuaugaguuaggcgagcccgcucaacuucaacguauaucuuuccuucuguaacuugcc

SEQ ID NO: 853 - RNA, 126 nt, Artificial sequence
  synthetic construct
guaauacuuugccaugacucggauguuguguuccacgacucuugauuuuaaaucugcccaucuuuuuguugcagccucaucuucagaaaaaacagguguggauuucagcuguuuuucguacaccuc

SEQ ID NO: 854 - RNA, 135 nt, Artificial sequence
  synthetic construct
gucucaucaacauaagugcagcauuccuggaccauuuuugcuaccgccuguuucaacugcgaccuucuuuuugucaaaagcacuauguguucauuaagagcagcccaguuuuuugcuucuuuacaaauuugacac

SEQ ID NO: 855 - RNA, 128 nt, Artificial sequence
  synthetic construct
guucuuauaauacacuccuccuuauugauaagaugugugauuuuguuaacucucugcaugaccugagugagaucgugggcccagucauuuagaacaucgcuaggaucuuugguuuguugaaagugcac

SEQ ID NO: 856 - RNA, 136 nt, Artificial sequence
  synthetic construct
gaccuaaauaguauaaaaaucuugcccauucauuguugcuggcugucucuggaaauacacauuugcucaccaguuuaucugcuugaucauauaacgaguaaugcagguaauuucuuaguaaacaauugacaagaac

SEQ ID NO: 857 - RNA, 130 nt, Artificial sequence
  synthetic construct
guuauuuuguucauuagugccugagaacaccuuucugcuucuuguaguuuauugguaucaaugagacgaaccaaaaucaauaaauuuauauauguaucaaccucugguaauggcgauuugguggcagauc

SEQ ID NO: 858 - RNA, 126 nt, Artificial sequence
  synthetic construct
gucaaggguugcuucuauaacuccaucucuaauugcuuucgcaacaaugaauucagcaucuuccgcugaaucaagucccaguuucuuggcaauaucuugaggagaaauucucgaguaagauaaucc

SEQ ID NO: 859 - RNA, 131 nt, Artificial sequence
  synthetic construct
gcuccuuuccauaagccuuuggaggguaucucaucgcuuucacacucugguuguguaaauccaaacaaaacgauauucgcugaugaaaagccaucugagguuccuuugugcaauaaauaucuguacuuucc

SEQ ID NO: 860 - RNA, 128 nt, Artificial sequence
  synthetic construct
guaauggcgauuugguggcagaucuggcccuugccuggguggugucuaaaucuccaacagcuucuucagugaaauucagcagagcuucacguucggagacaggauagauuugauugauaagacuucuc

SEQ ID NO: 861 - RNA, 152 nt, Artificial sequence
  synthetic construct
gccucuucuuucuuucccuccucugcaucuuuauugguaaguuuguuguugaucaaauugugcaaagccacgauagaccuaaccaaagcagcaagauagacaaccaacauuuggucauuguuuuuuauauagaaggaugaguugaaaguggc

SEQ ID NO: 862 - RNA, 131 nt, Artificial sequence
  synthetic construct
gcauuuacuuuuuugaacauuccauacauauuuuccagguagucgugguccagaaaccacacggauuuaucuuugucaucuucaucaaaaggaacugcaaagcuauuggagacgucgaggacuccuuuagc

SEQ ID NO: 863 - RNA, 130 nt, Artificial sequence
  synthetic construct
guuuggcaucaauuauuaccaacacagaauugggacaguaucuccuaauuaguucguuuauugcuaugucauucuggucuaauuuuggaccugugugguaccaaccuaccacucgcucccuagcauuuac

SEQ ID NO: 864 - RNA, 134 nt, Artificial sequence
  synthetic construct
gaccuuucaaaccuaagaguugauugguuauucguugagacaacgugccaacugugguaucuuugauaucccucagaaggugcuccacucccaccuccucugcuucuuccgccccuauuucgcuagguacaugc

SEQ ID NO: 865 - RNA, 118 nt, Artificial sequence
  synthetic construct
gucauccuucuucccaucuuuaucuuuuuccuucucuuucuccuuauuuucuuuaucuuuuuucgccucuucuuucuuucccuccucugcaucuuuauugguaaguuuguuguugauc

SEQ ID NO: 866 - RNA, 130 nt, Artificial sequence
  synthetic construct
gcgcauaauaguuaauguugucauaucuaaagcuacucuugucccugcuuucaauuuagcuuuaucuaauugucuucgacagccaacaacguagcggggaccguuaguagcuuuaacaauaaauuuuucc

SEQ ID NO: 867 - RNA, 133 nt, Artificial sequence
  synthetic construct
gccaccuauggcaucaauuucauccauaaaaaugauacaagguuggugaucuuuagcguaauuaaacauuucucuuaucaaucuagcagauucuccaauguauuuaucaacaauugcacuggaaacaacuuuc

SEQ ID NO: 868 - RNA, 130 nt, Artificial sequence
  synthetic construct
gaauuacauauucucuuucugcccggauugcaaacaacccugcuucuguacacacauuucucaaaucugcuccauugaaggagucagauagcuugacaauugccucguagucaauuucaccauguuuggc

SEQ ID NO: 869 - RNA, 128 nt, Artificial sequence
  synthetic construct
gucaguuguuucaauaccucacccacaaucugucccauacuuuggagagcuuucaagucauuuucggacuuaucauauuguuuuguuaaaucuuucaacugcucccgcauuucuuucagucuagauuc

SEQ ID NO: 870 - RNA, 125 nt, Artificial sequence
  synthetic construct
guuuuuccaguuccuggggguccauauaaaaggcaacccuuuggaggugugauuccaacccucauaaauaguucaggauucagcagaggcaguucaauaaccucucuuaauucccgaauuuguuc

SEQ ID NO: 871 - RNA, 143 nt, Artificial sequence
  synthetic construct
gcuaauaccucaaccuuugccaaaguuaacaaccccacauuguuuucaggauuugaucguguuuuugagugacauacuaaauucacagcaucuugcugugcuuguaaucugcugggaacaaaguccccauuucucauauaauc

SEQ ID NO: 872 - RNA, 137 nt, Artificial sequence
  synthetic construct
gaauaaucuucaucugcuucaacuuccauagguucuucuuuagcuggaggagcacuaguugacgacucuugggcaucuugcauggacaucugcauggcaaaugcgaucugcucaucuucagucauguuagcaaaauc

SEQ ID NO: 873 - RNA, 130 nt, Artificial sequence
  synthetic construct
guacuuuguucuucgccuuguuccauugacauggcuaaagcccucucuaauagggcuucuucggugggcuccucuuugauugccuccguuuuaguaccaguuucuguuccagcaacaucuuuagcucuac

SEQ ID NO: 874 - RNA, 134 nt, Artificial sequence
  synthetic construct
gucuuccccaaagcuaauaagaucaacguugacuuuuucuuuuuugagcuucuuggcuaguuugacuaacucuuuuucuucauuuucuacaggacuaccaacaaaaacaacuaugcgcauuuuaugguuuuugc

SEQ ID NO: 875 - RNA, 126 nt, Artificial sequence
  synthetic construct
gacucgcaaggccaaagccaauucgggaucuucauugggaucaacuccaaauucauagccugaugcacuaaggccagcaccuccuguuccauccucucccuggauaauuggagacgaaaucaaagc

SEQ ID NO: 876 - RNA, 111 nt, Artificial sequence
  synthetic construct
gauagacauauucuuuucagaaucuuuuugcauaacuuuagcaacagccauuucaaaaucuuccugaguuacauguacucuucucucccucagugcauacauaccugcuuc

SEQ ID NO: 877 - RNA, 125 nt, Artificial sequence
  synthetic construct
gacuuucuuuuuguccauugguuuaacuacuucaccaacauaacuccccuguucuugaagcagcauuaauucuucucucaacauucgaacuuuugcauuuaguucauuucuuugugcuuguagac

SEQ ID NO: 878 - RNA, 129 nt, Artificial sequence
  synthetic construct
guacucuucucucccucagugcauacauaccugcuucagugcagacucccuuaacuucugcuccacuugccccaggcaucagcucagcaaucuuccucaaguuuauuccucuaguuagauucauuuuuc

SEQ ID NO: 879 - RNA, 131 nt, Artificial sequence
  synthetic construct
gcauuaauucuucucucaacauucgaacuuuugcauuuaguucauuucuuugugcuuguagacgacguaaauuuuggcuuuuuucagcaacuaugaguuguaacuccucuaucuuaguuauguaguaagac

SEQ ID NO: 880 - RNA, 132 nt, Artificial sequence
  synthetic construct
gaauaguucaggauguuucacagguaauucgauaaccucuuugauuucuuuuauuuguuuaucuaagccucccaccauuucguaaguugaaucagguacuuuuucaaccaucaucaaagauacaagaggauc

SEQ ID NO: 881 - RNA, 129 nt, Artificial sequence
  synthetic construct
guaacugcuucuuuagggucuuuguacugcuccacuaccagggcuacuauuucuaccaaagauaaaggguuuauuuuguuuucgaagguuuguaugaaauugugauaaaguugaauuaaguugucuccc

SEQ ID NO: 882 - RNA, 125 nt, Artificial sequence
  synthetic construct
gcaagaagauaaaaccuuccaugaacggcaguaaucccaucugcauuaucaaguguagcuuccacuucuucuauaaucuuuuuuguggcaucuaaaucauuuaguuuuucaagaugaauuugacc

SEQ ID NO: 883 - RNA, 130 nt, Artificial sequence
  synthetic construct
gaucagcuauugcuccccacugagauuucauagauucgaauuuauugauaucaccggaauugaaagcauacaacaguucaaucaaccaggcauuuucugucgauuucagagaauccaaaacugaaugggc

SEQ ID NO: 884 - RNA, 132 nt, Artificial sequence
  synthetic construct
gcccacauguucgcaccauucguugaaccucucaaccauaccagagaucugcaugagguuuaaaacacgagguuguacccaggucauguuuacaguauuggcaaccugaucaauagcacccuucacaagucc

SEQ ID NO: 885 - RNA, 146 nt, Artificial sequence
  synthetic construct
gcuccacuaccagggcuacuauuucuaccaaagauaaaggguuuauuuuguuuucgaagguuuguaugaaauugugauaaaguugaauuaaguugucucccuucugcagcucugguuucuuuaugaaggcgaggaguuugagaguc

SEQ ID NO: 886 - RNA, 126 nt, Artificial sequence
  synthetic construct
ggccuuuuguuucucgaguugugcucucaguuguuuauugaaaucaucuucaacauugucguccucccaguuaucuucccauacacuaaugucuugaucguccuuuuccuucccuguccagucuuc

SEQ ID NO: 887 - RNA, 133 nt, Artificial sequence
  synthetic construct
guuuauugaaaucaucuucaacauugucguccucccaguuaucuucccauacacuaaugucuugaucguccuuuuccuucccuguccagucuucuacaggaaauucuucaaauucaucaucuuccuccaggac

SEQ ID NO: 888 - RNA, 115 nt, Artificial sequence
  synthetic construct
guuuauugaaaucaucuucaacauugucguccucccaguuaucuucccauacacuaaugucuugaucguccuuuuccuucccuguccagucuucuacaggaaauucuucaaauuc

SEQ ID NO: 889 - RNA, 111 nt, Artificial sequence
  synthetic construct
gcauccucuucccagccggcgcuccauuucuuuugauuucgugccuccuuacuuuuugccucugauuucuucgagaacucuucaacuggcgacauaacaggacuguuauac

SEQ ID NO: 890 - RNA, 131 nt, Artificial sequence
  synthetic construct
gcugcuuuacuguuguauuuuuguugaauggacaugguaucuucccaaucuggcugcgccucgaagaauacucuugcguuucuguuaccaccaacuuucauuuucuccaacucuaugucuuuccauuuauc

SEQ ID NO: 891 - RNA, 126 nt, Artificial sequence
  synthetic construct
gcugacuucucgccaaccuuucuugcucaacucaccuaccuuuucuccuacuugagauccaauuucaacaaccuuuuggcuggcgaauccaccauacuucacugcauuuucaguugcuuuacuugc

SEQ ID NO: 892 - RNA, 126 nt, Artificial sequence
  synthetic construct
guaggcaccuugguaacuuucgguacuguuggaauaagaucuagugaaauuugacguggaaugaguaucucuugagcuguucuuuugagaggaagauccuacaaagcuacuauuguaauuuugagc

SEQ ID NO: 893 - RNA, 151 nt, Artificial sequence
  synthetic construct
gucacaaucauaauuuaaauauaacucaguauggaaaccagguauucuccacaacuggagcagguuuuccauagcaauuucccuauguucguggguuaucuuaguugaaucgcucgauaaaauguccaucaauuuuuuuaaauagaauucc

SEQ ID NO: 894 - RNA, 132 nt, Artificial sequence
  synthetic construct
gaucuauuauaauuauauauauuuucucuagauccacugucauuuaagcuuauuucauuauuuaauauuuuuuguuugcuuuucucuuugcaucgcuuuucgauuccuucaauagugauaagaagugcaucc

SEQ ID NO: 895 - RNA, 129 nt, Artificial sequence
  synthetic construct
gaauauuuuguaaaauagaaccuuguaaaucuacuacauuacuaacagauaggguuguuaaugguguugacgauauggaacuuggaguugaaucuugaacuacuuuugguggaacaaaggacugaauac

SEQ ID NO: 896 - RNA, 129 nt, Artificial sequence
  synthetic construct
gauaacucuaucaaaguuuuaaccauuuccagaagagcauuuucauggagaaauuuagagucgguuaucaacugauccaaauuacaaucuuuuauacauucuuugguuauuucaauaaaauauuguucc

SEQ ID NO: 897 - RNA, 145 nt, Artificial sequence
  synthetic construct
guucaaaccccuuuauuauuuuuuuguauauacuuggauugucacucuuuucaaaaccagaugauagagcagacacagcuggaccauauagaaucugaaauaauucaaaaucauaugugccacuauuuucaugaacauacgaagc

SEQ ID NO: 898 - RNA, 134 nt, Artificial sequence
  synthetic construct
guacgucucccacuacuaacauuugaggagcugccaauguacccuuuauauuauagaaaugaaccgaacuauuguaaguaaugaauccaacuuucauauugcuuuuuucuuguccuugauccacagguagauuc

SEQ ID NO: 899 - RNA, 129 nt, Artificial sequence
  synthetic construct
guccagauguugaaaguacuccguuggaacaucaguuguagccauacagaaaagacacugaaaucuucuuccugaaucaaugaauugcauaaaugggcacauguaggcuuugcaccguauacaccuaac

SEQ ID NO: 900 - RNA, 138 nt, Artificial sequence
  synthetic construct
gauuauaucauugauaagucguucgccaucgauaucagcuuggaaauauguauacuuaaagacuucuccaccugucaaucucgaaaccugacugauuguagcuaugucaauguaugaauuguugaauaugaacaaguc

SEQ ID NO: 901 - RNA, 145 nt, Artificial sequence
  synthetic construct
gacucaacacuacgcugaagggaacugauguuuguuugagaauauccugugaaauugguacauuauacauuguagaucuaaugaaccuuggacuagcauuuccuugaucuugaacaacaaaacuggugguaacuaguggaggaac

SEQ ID NO: 902 - RNA, 128 nt, Artificial sequence
  synthetic construct
gucuacagaacacccagcuccaacacaauccugacccaacugauuguaaaccugacuuugagggguuaaaacugucuuuucuuuaucaguuccuaguacuuugcggucaucacgauuuuuaaguuugc

SEQ ID NO: 903 - RNA, 127 nt, Artificial sequence
  synthetic construct
gguaugaauggagaguccccuggugcaccuaauccucauaacagccucgaaaccaaucuuccuagucaaauaccuccuaaaacaucuggcgaagcucucgcagaguauggucuucgucgguuugagc

SEQ ID NO: 904 - RNA, 127 nt, Artificial sequence
  synthetic construct
guugcaaaaacucaugauaagacaaagcguuuucaacacgaucuucuaucaaccguucgaaaaacacaacucuacaacuauuauugucccuaaucacuugcaacguagcugaguaaggcuuaucguc

SEQ ID NO: 905 - RNA, 137 nt, Artificial sequence
  synthetic construct
gacccacauugggaagcgaugcuugaaaaacggugacacgacccccaguagagcucaucaacuugaaggccacuugcaaggcugcaccuaaagcagaguuagugucguaaguauuagaaaaucgagaagguaguagc

SEQ ID NO: 906 - RNA, 130 nt, Artificial sequence
  synthetic construct
guucucaagacaccuagcagucaguugcagucugggcggcaucgaaacggguuccucuucugaguucaaaaucacuuccugauucuccaaaucguguaucggguacaaguccggguauauauucugaauc

SEQ ID NO: 907 - RNA, 129 nt, Artificial sequence
  synthetic construct
gauacuguuauaauuacugacuccuagcgcuuccgauaaaaacuccugcgaaacguucggacacacuaaaaucaccauaugcucgccuguguccaugaggaaggcccccuuguucucaagacaccuagc

SEQ ID NO: 908 - RNA, 138 nt, Artificial sequence
  synthetic construct
gcugcaaaauuuucuauccuauuuaaauuaucaaaaucauuuguuaauccauccacaauauucugcucaucuuucguuacauacugauucaauuuauuguuaaugucuucgauacuauaucccaacaaauugagaagc

SEQ ID NO: 909 - RNA, 127 nt, Artificial sequence
  synthetic construct
guguuguugaaugcguucguuauuugacuggagaaagauugucuaugacuacuucuucuacuuugcugcugucguacuuccugaacauucacuggcuucugaccaagggcuacauaaaggcggucuc

SEQ ID NO: 910 - RNA, 127 nt, Artificial sequence
  synthetic construct
gcaggagaggauugaauauuugacugccugggguagaacuaggaacgauuggagguugaguguaugaauuguuggcaaagguguuauuuugguaagaauucacagguuguggaggaaacugguuugc

SEQ ID NO: 911 - RNA, 128 nt, Artificial sequence
  synthetic construct
gcuucaacguuauucaucaacagugcuuguguuauaaggccuucagugucgucauuuguuuuuauuuugaauaguucagucuuuuuuguaucuuuuugcagagguguggaacuugaaacaucaguggc

SEQ ID NO: 912 - RNA, 138 nt, Artificial sequence
  synthetic construct
gaaauccauugcauggacuggccccguauguuuuucuugcuuuccaacaauggcaucuucacccuucaauaauuuugaagcacuauauauuugaauuaauccaccaucacauccuccaacuauuguaccacuggguuc

SEQ ID NO: 913 - RNA, 141 nt, Artificial sequence
  synthetic construct
guuaccuaauauaagaaccggacaauucgaaagagucucgucugugaguagcgaauccaauucuuguuuacucucuuugaaucuguuccuaucauuggcaucuacuaaaaagacaauggcgucaacagcagggaaguaguc

SEQ ID NO: 914 - RNA, 131 nt, Artificial sequence
  synthetic construct
gccuaucaucuuugagcauaugcaguaaaguuguuuuuccagcauuguccagaccuaggaaaagcagcuugccugauuucuuccauaaucccaaguaaccaaguacaccgguaaaccaaucccagaugaac

SEQ ID NO: 915 - RNA, 132 nt, Artificial sequence
  synthetic construct
gugaauggccucccaaaucaaaagucgugaaccucaugcugccgauugacaauucuucugauguaggauguaaagugggaagaugcugugccagccuaucaucuuugagcauaugcaguaaaguuguuuuuc

SEQ ID NO: 916 - RNA, 136 nt, Artificial sequence
  synthetic construct
gcauaguaauuucuuaguucgucuuccgaagcugcuugaggcaaaucaauuuuguuaccuaauauaagaaccggacaauucgaaagagucucgucugugaguagcgaauccaauucuuguuuacucucuuugaauc

SEQ ID NO: 917 - RNA, 131 nt, Artificial sequence
  synthetic construct
gcaaaucggaccuugccaccuuucccuuuccaguuguuuggccauacaaggcauaguaauuucuuaguucgucuuccgaagcugcuugaggcaaaucaauuuuguuaccuaauauaagaaccggacaauuc

SEQ ID NO: 918 - RNA, 132 nt, Artificial sequence
  synthetic construct
gcccaagccacaucccuaacccagucggaauguacuucuaauuuugauucuucuacccaccuaucaccaucuucuuuccaaauuuuuauuagguuaucacaaccuccagaaaccagccucuugacagguugc

SEQ ID NO: 919 - RNA, 126 nt, Artificial sequence
  synthetic construct
gcccuuagcuacaucacuuaugcacugccaaacuccuucaguguuuugaucccacaaggugauuuuauuaucuccaccagacacugccagaauauuuccauucaaagaccaacugacauuccauac

SEQ ID NO: 920 - RNA, 135 nt, Artificial sequence
  synthetic construct
gccccauuuuuuauaucauauacuuuaacacuguuaucugaugaacaaguggcuaaacgcaaaccguaauaauccacuucagcaucguguaucauaucuucauggccugugucgauagaauuuaauauugaaacc

SEQ ID NO: 921 - RNA, 126 nt, Artificial sequence
  synthetic construct
gggcgaauugaacagaguugacacuagaaucaugauuugcauauucauaguauuuugaccacuuccucuguuguucuuuccauauuaucacuuuucuaucauaggaacaagaugcuaggagauugc

SEQ ID NO: 922 - RNA, 401 nt, Artificial sequence
  synthetic construct
gugauuuucuucagcuugucacguuuacgaauggacaacacugccuuaacuuuacguuuaguuuccaaaguacguacaacagauugguacuuccauccaacuucaugggacaaucuuccuacgugacagaacuuacguccugguuuaagacaaauaauucucagagcaccaggaacuacaacacguuuccuacgaucauaaggugguggaauuccuucguaugcuuucaauuuacgaagagccuguuuuccucucucaguuuugugggguaacauuccucucacaguuuuccagaaaacucuggauggugcucugaaguggaauggaccacgggcuggauugacauugcaacgcuugcgaagaaaugauaggaauuugaguuuauuucuguagaaauuucc

SEQ ID NO: 923 - RNA, 405 nt, Artificial sequence
  synthetic construct
gccuuaacuuuacguuuaguuuccaaaguacguacaacagauugguacuuccauccaacuucaugggacaaucuuccuacgugacagaacuuacguccugguuuaagacaaauaauucucagagcaccaggaacuacaacacguuuccuacgaucauaaggugguggaauuccuucguaugcuuucaauuuacgaagagccuguuuuccucucucaguuuugugggguaacauuccucucacaguuuuccagaaaacucuggauggugcucugaaguggaauggaccacgggcuggauugacauugcaacgcuugcgaagaaaugauaggaauuugaguuuauuucuguagaaauuuccugauauguucauuuguucgcaccuaacuacagucacuuuguugccc

SEQ ID NO: 924 - RNA, 404 nt, Artificial sequence
  synthetic construct
guuucauuaucauaaccagggaaacguuuuguugaauggggaauguugagaccaccaucuacugcacccuucauggcugcaaacacgcgagcuccuguacugguacguugaaguccaacaucaagguagcaucugaaagcuccugggccauuuucaacaccuucaacauuguauucaucuccaguuacgucaguuguuccuucauacaagguaucaagucccaguuucuucaguaaucggcgagccaacaacaaaccuguagcauaggcugcugcauaauucgucaaaccagccuuaaucccauacuugggcaacucaugagaauacgcagcgcagacaaucuuaucaccuucaauacgagaauacgcaauuugacagguuacguuacgauuagaaagucguac

SEQ ID NO: 925 - RNA, 403 nt, Artificial sequence
  synthetic construct
guugaaguccaacaucaagguagcaucugaaagcuccugggccauuuucaacaccuucaacauuguauucaucuccaguuacgucaguuguuccuucauacaagguaucaagucccaguuucuucaguaaucggcgagccaacaacaaaccuguagcauaggcugcugcauaauucgucaaaccagccuuaaucccauacuugggcaacucaugagaauacgcagcgcagacaaucuuaucaccuucaauacgagaauacgcaauuugacagguuacguuacgauuagaaagucguacaaucaaacgauauuuggggguguuguacuuauucuuaucuuggacgaugagacguuuacgagcauaauaaucagucuuucccuggcgacgccucuugaacuuuac

SEQ ID NO: 926 - RNA, 401 nt, Artificial sequence
  synthetic construct
gauuuuugucaagguggacuuuaaugaguugugagccgucuaaccucacacgaauacguuuaccaacaauuuccgcaggaaacacaaggucuuccaaaauagcaucauacacugaaguaaguguacgagaccuuggucguuucuguuuauuugcagcacgaguuuuacguguuggcuugggaagaauuuuucguucaccuacaaacaccacauguuugccacugaacuucuuuuccagcucacguacaagccuugcuuggacuuucuggaacuguuucaacuugggcauuggaacauagaugauaacggauuuuuuauuguucaacucaauuucucuugcuuuaguaauguguaauucccuaagcugagcuuugagguccgaauucauuucuaaaucaagc

SEQ ID NO: 927 - RNA, 402 nt, Artificial sequence
  synthetic construct
guaaguguacgagaccuuggucguuucuguuuauuugcagcacgaguuuuacguguuggcuugggaagaauuuuucguucaccuacaaacaccacauguuugccacugaacuucuuuuccagcucacguacaagccuugcuuggacuuucuggaacuguuucaacuugggcauuggaacauagaugauaacggauuuuuuauuguucaacucaauuucucuugcuuuaguaauguguaauucccuaagcugagcuuugagguccgaauucauuucuaaaucaagcagagcuugagcaacuugcguuucgaaggcaucgggcucagccccgccggacuugaugauuuucgacgacauaaucggacuauauucugcagagaaaacacuaauauauuguuucgac

SEQ ID NO: 928 - RNA, 402 nt, Artificial sequence
  synthetic construct
gauuaguucauccuucugcuucugggaguuggugaccguuacaccuggagccauuuugacucuccugauauacuuuucacccaagaaauuccugauuucaauaauggaauuguuuucugugguuacacaauugaugggaaaaugagcauauacggcccucauuuuguauugguaaccuuucguuacaccuuucaacauauuuucuacgugggaacacacuguccugacagcagccaauuccuuuuucguaccgaaccauuuuucuacucucaagguucugggguuaaccauacgaauauccaaagccaaauguuugaaagagcguuucagggugccucuagguccuuuuacugugauaguacgggauuuggcagugaccgugauccccucagggauuuugac

SEQ ID NO: 929 - RNA, 401 nt, Artificial sequence
  synthetic construct
gggaguuggugaccguuacaccuggagccauuuugacucuccugauauacuuuucacccaagaaauuccugauuucaauaauggaauuguuuucugugguuacacaauugaugggaaaaugagcauauacggcccucauuuuguauugguaaccuuucguuacaccuuucaacauauuuucuacgugggaacacacuguccugacagcagccaauuccuuuuucguaccgaaccauuuuucuacucucaagguucugggguuaaccauacgaauauccaaagccaaauguuugaaagagcguuucagggugccucuagguccuuuuacugugauaguacgggauuuggcagugaccgugauccccucagggauuuugacgauuugguuuguuacaaucugc

SEQ ID NO: 930 - RNA, 401 nt, Artificial sequence
  synthetic construct
guguguaccagaagcgacuuccuaagaguuauaauucgcuucuuggguccaauacaacaacccuugaucauaacaaagucguuauugacuucaccguagugagggaagccacccauuggggugauggacuuuucacucaaaucguauucaguugaagcauuguucuugaugaccuuuccaucuuucguauggauaccggcaccaauccuguauaucuucuuauucauuucaguacgaugaugguaacccuuuugaccagcacgggccacggugaaugaaacucuagaaggaugccaugcuccaauacaggcaaccuuacggagacccuugugcgucuuucggggcaacuucuucgugugccaacgugaagucacaccuuuauaaccaugaccuuugguaac

SEQ ID NO: 931 - RNA, 407 nt, Artificial sequence
  synthetic construct
gacuuuucacucaaaucguauucaguugaagcauuguucuugaugaccuuuccaucuuucguauggauaccggcaccaauccuguauaucuucuuauucauuucaguacgaugaugguaacccuuuugaccagcacgggccacggugaaugaaacucuagaaggaugccaugcuccaauacaggcaaccuuacggagacccuugugcgucuuucggggcaacuucuucgugugccaacgugaagucacaccuuuauaaccaugaccuuugguaacaccaaugcaaucaaucauuucaucuugggcaaauacauugcucacaggaacugguuuuucgagguguucccuagcccaggcuacuuuaucagcaacugugccaccauucaauugaauuuccauaaugugggc

SEQ ID NO: 932 - RNA, 363 nt, Artificial sequence
  synthetic construct
guuguugggcucguucaacgauuucuuugcguuucuucgacgaaacuccgugagcuauuucugcacaauauuugcgguuuugcaucaugaggaccucgaguuccuugagguugugcaccaacacuuuacggaauccaguaggaagcauaugacgaguuuuggaguuagauccauaaccaauauugggcaucaaaaacugucccuugaaacgccuucugacucuguuaucaauaccuuuugguuuucuccaguugcgcuuaaguuuuccauaucggucugauuggugucugaugaauuucuugguucucuuuuuuauaauguuuggccuguagacuggucugauggccauuauguacagauuac

SEQ ID NO: 933 - RNA, 404 nt, Artificial sequence
  synthetic construct
guuuuuuuugugucaugauugugggcaauaacuguugcauaguuuccagaugcccuugcaagacgaccacgaucgccagucuuuucuucuaaguuacauacgauuguaccuucuggcaugguuccaacaggcaaaacauuuccaaucugcaaacuagccuucuuuccgcaauacagaaauuguccuguauacaucccuucgggagcaaugaauaacucuuuucuuguuuggaauuuauagggaucccugaaaugaaccauagcuaauggagcgccacggccgggaucgugcauuauuuccuuaacgacaccuuuaauauauccaugucgcucagaaaaguccaaauaacgcaauuuuggugcuccuuuccuucucuuuguaugagauuugaacacugaucccgc

SEQ ID NO: 934 - RNA, 402 nt, Artificial sequence
  synthetic construct
gcaacaauaccaaccauggcccuauuguuggaaggaaugacuuuuuuggcaccagaugguaacuugacccugguuuuuuuugugucaugauugugggcaauaacuguugcauaguuuccagaugcccuugcaagacgaccacgaucgccagucuuuucuucuaaguuacauacgauuguaccuucuggcaugguuccaacaggcaaaacauuuccaaucugcaaacuagccuucuuuccgcaauacagaaauuguccuguauacaucccuucgggagcaaugaauaacucuuuucuuguuuggaauuuauagggaucccugaaaugaaccauagcuaauggagcgccacggccgggaucgugcauuauuuccuuaacgacaccuuuaauauauccaugucgc

SEQ ID NO: 935 - RNA, 408 nt, Artificial sequence
  synthetic construct
gcaccaauaccaggccuaccguguuugacagguuuguaggucaaagaaaauucuccaagguaguguccaaucauuucagguuugauuucaaccugcgugaaggcuuuaccguuguaaacaccaacaauagaaccaaccauuucaggcacuauuaucauauuacguagauguguuuuuacaauuucuggcuucucuagaggaggggcuucuuucuuggcuuuacggaguuucuuuacuaacgccauagguuuacguuuaaguccucuagugaaacgccuucuugcucuacaaugcaugaguuccaucagcuguucauuaggcauauccagaaguugauccagaucaacuccucuaaaggugaacuuuuugaaaguccucuucuuuuucacuuguucaucaacuuuaucc

SEQ ID NO: 936 - RNA, 401 nt, Artificial sequence
  synthetic construct
gaggaauaaaccuggagcuguggguagcaccaauaccaggccuaccguguuugacagguuuguaggucaaagaaaauucuccaagguaguguccaaucauuucagguuugauuucaaccugcgugaaggcuuuaccguuguaaacaccaacaauagaaccaaccauuucaggcacuauuaucauauuacguagauguguuuuuacaauuucuggcuucucuagaggaggggcuucuuucuuggcuuuacggaguuucuuuacuaacgccauagguuuacguuuaaguccucuagugaaacgccuucuugcucuacaaugcaugaguuccaucagcuguucauuaggcauauccagaaguugauccagaucaacuccucuaaaggugaacuuuuugaaaguc

SEQ ID NO: 937 - RNA, 409 nt, Artificial sequence
  synthetic construct
guacacccauuuuccugcagagggcggguaagaauaacaccaacucaauaggguccacgucgugggcaaucacuaccagcugagcuuucuucuguucaaugaguuuaguaacaguguuaguuccagcccugaggguguuuggccucuugguaggggcuuccucuuucuuggccacuuuagcuucggcuuuagccuucagccuauuccuuuuuuggagagcugucucuggucuguauuucucuaggaguuugaacaacuggguggcuguuuguuugucaacgguuugaguaaacugauugauuggcggaggaaccuucaaucucuucugcaaaacggccuucugccuuugaauucgaauguauuuuggccauuugacgaaccucgauaaaucacguggagguugaauauc

SEQ ID NO: 938 - RNA, 403 nt, Artificial sequence
  synthetic construct
guuuaguaacaguguuaguuccagcccugaggguguuuggccucuugguaggggcuuccucuuucuuggccacuuuagcuucggcuuuagccuucagccuauuccuuuuuuggagagcugucucuggucuguauuucucuaggaguuugaacaacuggguggcuguuuguuugucaacgguuugaguaaacugauugauuggcggaggaaccuucaaucucuucugcaaaacggccuucugccuuugaauucgaauguauuuuggccauuugacgaaccucgauaaaucacguggagguugaauauccugaccgauuccaaaguuccuuacccucuuuucgaaaagaggguuaaccuccuucuuggacucuacuuucuugacugccaaaggagcagcugcaac

SEQ ID NO: 939 - RNA, 404 nt, Artificial sequence
  synthetic construct
guccacgacgaccucccuuccuacgaguggaaucugaggggauugguguaacgucuucaaugcguccaaucuucauguuggaacgagccaaagcucugagggcacucugagcuccugguccaggaguuuuugucuuguuaccaccgguugcucgcaacuugauguggagugcaguaauaccuaauguuuugcauuuuucagcuacaucuugagcugcuaacauagcggcauaaggagaagcuucaucucugucggcuuuuacuuucauaccaccaguaacucuggagauaguuucucuuccagacaaaucaguuacauggacgaaaguaucauugaaacuugcaaaaaugugggcaacuccaaaaacuauuucgccuucucggacuugagguccaagugaaagc

SEQ ID NO: 940 - RNA, 406 nt, Artificial sequence
  synthetic construct
gaaucugaggggauugguguaacgucuucaaugcguccaaucuucauguuggaacgagccaaagcucugagggcacucugagcuccugguccaggaguuuuugucuuguuaccaccgguugcucgcaacuugauguggagugcaguaauaccuaauguuuugcauuuuucagcuacaucuugagcugcuaacauagcggcauaaggagaagcuucaucucugucggcuuuuacuuucauaccaccaguaacucuggagauaguuucucuuccagacaaaucaguuacauggacgaaaguaucauugaaacuugcaaaaaugugggcaacuccaaaaacuauuucgccuucucggacuugagguccaagugaaagcuguacuucuucuuucuguacuuuuccuuuuc

SEQ ID NO: 941 - RNA, 262 nt, Artificial sequence
  synthetic construct
gauauaggauacuuacuuuguacauuuuggcuaauuuuucccugauauccguuuuuuuaacagaagguuggccgggauguaaaacaucaacgaccauuuguuuccgagccaacaaucuguuggucaugaacuuucggguccuaaucgucgcuguucccuccgucugaaacauaacgagaaauuugaguaaaucgcgagagagguuaaguaauaauaacaucagaauuucgucaaauucacaaguuauuucacaaauuucauc

SEQ ID NO: 942 - RNA, 354 nt, Artificial sequence
  synthetic construct
guacagccucuggggaggucccaucgaagacuugacgugcaacgaccuaacguuuugccaauguuucuucaacagcgaaaccaaaaaguucaccgaaagauggacguuuuguaccaguucaucggaauucaugucaacaugcccaacagcaacagaaaggcaaaguaccuuuuucaucuggaacuugaugguugccuugaccucgucaaucuucugagucaucgauucuugaugcgagagaagaccagggaacuugccggcuuuguuuagaccgggucccaacagccuagggaucugcuugaugagagcaucagaagcaaggaaagcaucauacuuuuuugccaguuucuugac

SEQ ID NO: 943 - RNA, 406 nt, Artificial sequence
  synthetic construct
gcuucuccagcacgaagcuucuucuuauugugaacggggaaaagaaugaguuuagauuuauauucuuucaaacgcugaguguucaguugaacagauucgauugacuuguuucuucgacgagcaucuacugaaauuccaaugguucuggcaaaucguggguuaagaccugcagcuuucaauucuugaagggugaaaccacguccagcacgaacuuuaguaugguaucuuacugacgggcaucuuaccacaggucucaaggguccugcagcuggucugggugcgauggcuuuggcuuuuuucaaacgguucugccuucuacgaugcuuucgggcggguugauuaaaccauguuuucacaaaacguugccaaucuuuauggaaauguccauuaggaaucauauuauuac

SEQ ID NO: 944 - RNA, 408 nt, Artificial sequence
  synthetic construct
gaaccuuugccuuugucuugauggauggcuggugaauaggcaaaaccucaccauucaacugaguagcaaccuuacgcuccucuucgguagcuucuccagcacgaagcuucuucuuauugugaacggggaaaagaaugaguuuagauuuauauucuuucaaacgcugaguguucaguugaacagauucgauugacuuguuucuucgacgagcaucuacugaaauuccaaugguucuggcaaaucguggguuaagaccugcagcuuucaauucuugaagggugaaaccacguccagcacgaacuuuaguaugguaucuuacugacgggcaucuuaccacaggucucaaggguccugcagcuggucugggugcgauggcuuuggcuuuuuucaaacgguucugccuucuac

SEQ ID NO: 945 - RNA, 403 nt, Artificial sequence
  synthetic construct
gaacuugcuguccuuguccuuucuguuccuuuccaaaugcuuacguauagccacugcuuucuugaugagguaauauaaaucuucgggcagaucgggggccaaacccauagcuuucaugaggcgcaaaauuuuguuuccagaaacaaaucucacuugggcgacuccauaagaaucccuaagaauuacaccaaucugugauggagucaauccuuuuuugccaaguuugaauauaugcucuuucacuucuucugguguaacuuucaaccagguagguacgcuucgucuauaagguaaagccgauugggcuauacccuugccaggugcgugcauucgacccauuuuuaaaugaaaaauugaaaacacgcuauucccgacaaauggagcuacguuaaaagaacaaccc

SEQ ID NO: 946 - RNA, 403 nt, Artificial sequence
  synthetic construct
gccaaucgguggauacgugauucgaccaaaaucaaacggaacuugcuguccuuguccuuucuguuccuuuccaaaugcuuacguauagccacugcuuucuugaugagguaauauaaaucuucgggcagaucgggggccaaacccauagcuuucaugaggcgcaaaauuuuguuuccagaaacaaaucucacuugggcgacuccauaagaaucccuaagaauuacaccaaucugugauggagucaauccuuuuuugccaaguuugaauauaugcucuuucacuucuucugguguaacuuucaaccagguagguacgcuucgucuauaagguaaagccgauugggcuauacccuugccaggugcgugcauucgacccauuuuuaaaugaaaaauugaaaacacgc

SEQ ID NO: 947 - RNA, 404 nt, Artificial sequence
  synthetic construct
gauugaguuucaacaaagcucugguauuggucaaaggauucagacggcguacacgacgaacaaccuucuucuguggagcacgaagaacagccuugauuucaucagccuucaauaaccuggacaaauccguguuggacaucuugggcuguggcagguuguaacccuucuuuuccaaggaaggggucuuccagcugccgaacaguuuguccaaucguuggaaggcagauucgguccagaugacgaaacguccaacgugaccaccgggagcgaguuucaacaagcugagcuucuccacgcugaccagaucgaugccaggaauguuacggaaggcacggcggaggccuugaucuuugugguaaacgacgagagguccuuuccuuuggaugcgucuucuauuacgcauc

SEQ ID NO: 948 - RNA, 401 nt, Artificial sequence
  synthetic construct
gucaacaaagcuugucgcuucaggacugcagcguauggauugaguuucaacaaagcucugguauuggucaaaggauucagacggcguacacgacgaacaaccuucuucuguggagcacgaagaacagccuugauuucaucagccuucaauaaccuggacaaauccguguuggacaucuugggcuguggcagguuguaacccuucuuuuccaaggaaggggucuuccagcugccgaacaguuuguccaaucguuggaaggcagauucgguccagaugacgaaacguccaacgugaccaccgggagcgaguuucaacaagcugagcuucuccacgcugaccagaucgaugccaggaauguuacggaaggcacggcggaggccuugaucuuugugguaaacgac

SEQ ID NO: 949 - RNA, 401 nt, Artificial sequence
  synthetic construct
gaguuugguccucgccugcguccgaauguagcuacuacauuaacgaaccuccuguuguacuggauacgccucuuugcucugccagucuucuucuuuuucuuuucuugcuucuccacuuuagguguuuguccuuuaaccuuaccagcacgggccaaagaaccauggacuuuuccuccaaggagaccaacagucaguucaauaucaacauuuuggaauuccgauaccaaacuuucaucugaaacugggauaccagcagcauacaaggugaucucagauucuuucaaagacuccaaagaggcaacacgguccuuaauuuggccaauuguuagccccucuucacacucaagaaaguggguaguuugaccucgaacgcacaacugcauuuuggaguuuuugguuuc

SEQ ID NO: 950 - RNA, 406 nt, Artificial sequence
  synthetic construct
guccucgccugcguccgaauguagcuacuacauuaacgaaccuccuguuguacuggauacgccucuuugcucugccagucuucuucuuuuucuuuucuugcuucuccacuuuagguguuuguccuuuaaccuuaccagcacgggccaaagaaccauggacuuuuccuccaaggagaccaacagucaguucaauaucaacauuuuggaauuccgauaccaaacuuucaucugaaacugggauaccagcagcauacaaggugaucucagauucuuucaaagacuccaaagaggcaacacgguccuuaauuuggccaauuguuagccccucuucacacucaagaaaguggguaguuugaccucgaacgcacaacugcauuuuggaguuuuugguuucccucaacacgac

SEQ ID NO: 951 - RNA, 408 nt, Artificial sequence
  synthetic construct
guccuuuccaagagcagccaaucgucccuuggcucuacgaucaauaaucuucuuucuaucuuuguccauuuugaguuuaacaauuacaaccuuugaagggugaauucccacauauacacuggcaccauuugccuuuucucguugaauucucucaauauagauaacgaauuuuuuccuguacacuugaacaacuuuuccgacuuguuguccuuuauaauguccccuuacaaccuguacuucaucguccuuacgaaugggcauggugcacacauuguauuucugccugagcuccuuagacaaaggggcugacauaaguuuccuucgaauaugagaaggcgccgugaagugccuuuuccuguuuuugcuucuugaagcaguaacuaguuuguugaauuucaucuugcacuc

SEQ ID NO: 952 - RNA, 404 nt, Artificial sequence
  synthetic construct
guccuuuccaagagcagccaaucgucccuuggcucuacgaucaauaaucuucuuucuaucuuuguccauuuugaguuuaacaauuacaaccuuugaagggugaauucccacauauacacuggcaccauuugccuuuucucguugaauucucucaauauagauaacgaauuuuuuccuguacacuugaacaacuuuuccgacuuguuguccuuuauaauguccccuuacaaccuguacuucaucguccuuacgaaugggcauggugcacacauuguauuucugccugagcuccuuagacaaaggggcugacauaaguuuccuucgaauaugagaaggcgccgugaagugccuuuuccuguuuuugcuucuugaagcaguaacuaguuuguugaauuucaucuugc

SEQ ID NO: 953 - RNA, 403 nt, Artificial sequence
  synthetic construct
gaaguccuuugaauguuggcacugcaacauauguuacgagaguauacaguuuguugacugaaucuucaucaucauuucuucuccuggacagucuaacacggacacggaaaggaacguuccugauuccuuuagaccacaauuguuuauuaagucuagugucaauucuaacgucuggaguucccauuuguuuuucugcgaauugucggauggcuuugauagcccuaggagcacguuucuugaagccaauaccaugcaaccuuuuguguagguucacuguguauucacgaguaaccacuucguugauggcagauuugcccuucuuuucucccuucuguuuugccauugcgaccugaauauauaauaagaacagaaaauggcaaaauuuugugaaauuuguauggac

SEQ ID NO: 954 - RNA, 403 nt, Artificial sequence
  synthetic construct
gucuguauuggacauugcaaccaucaggagccaaucgaccuucugauuucaaaguuucauauugcucucguucauauuucgucuugggacugugagguuucacaagaacaagauggguagacgaccagccagauguuaucguuauugcaaaaauaaaccauaccccaagucucguuucugucgugguguaccagauucuaagauucgaauuuucgaucuugguaaaaagaaagcuccaguugaugacuuuccucuuuguguacauuugguuucugaugaauaugaacaacuuaguuccgaagcgcuggaagcugggcguauuugcuguaacaaauacuuggucaagaauuguggaaaagaucaguuucauauacguaugagacuucauccauuccauguuauc

SEQ ID NO: 955 - RNA, 402 nt, Artificial sequence
  synthetic construct
gcccacgaucuggucuguauuggacauugcaaccaucaggagccaaucgaccuucugauuucaaaguuucauauugcucucguucauauuucgucuugggacugugagguuucacaagaacaagauggguagacgaccagccagauguuaucguuauugcaaaaauaaaccauaccccaagucucguuucugucgugguguaccagauucuaagauucgaauuuucgaucuugguaaaaagaaagcuccaguugaugacuuuccucuuuguguacauuugguuucugaugaauaugaacaacuuaguuccgaagcgcuggaagcugggcguauuugcuguaacaaauacuuggucaagaauuguggaaaagaucaguuucauauacguaugagacuucaucc

SEQ ID NO: 956 - RNA, 408 nt, Artificial sequence
  synthetic construct
gcuuccucagcaguaauacgaugcacugcaaaucguccuuuaacaucauagaugagucggaaaaauucaccaguuuuuucaaugguaauaacauccauaaacccagcaggguaauuggagucgguccucacuuuuccaucuacuuugauuaaccuuugcauaacaaucuuaguaacuucgcuguuagucaaagcauacuucaaucgguuacguaggaagaucaccaagggcaaagacucucgcaauuugugagguccuguagaugggcgaggugcgaaaacaccucccaauuuauccaacauccaugcuuuuggggcauucaaacgcuucaagugcuucuucggaccucgagccauuuugcacucaacuuuacaaucaaaaagaaaagagagacaccaaacuuccaac

SEQ ID NO: 957 - RNA, 401 nt, Artificial sequence
  synthetic construct
guacuuugcuuccucagcaguaauacgaugcacugcaaaucguccuuuaacaucauagaugagucggaaaaauucaccaguuuuuucaaugguaauaacauccauaaacccagcaggguaauuggagucgguccucacuuuuccaucuacuuugauuaaccuuugcauaacaaucuuaguaacuucgcuguuagucaaagcauacuucaaucgguuacguaggaagaucaccaagggcaaagacucucgcaauuugugagguccuguagaugggcgaggugcgaaaacaccucccaauuuauccaacauccaugcuuuuggggcauucaaacgcuucaagugcuucuucggaccucgagccauuuugcacucaacuuuacaaucaaaaagaaaagagagac

SEQ ID NO: 958 - RNA, 305 nt, Artificial sequence
  synthetic construct
gcuugcuaagauuauuccaucguauuucuguuggaaccacuucauggcgucuuccuuggucaaucgguggcugaauccuacuuugccuuguuucgcccuccugugagcuacauugaaaccuggacgacccaacacaacguagaaaucuaaaccauagauuccaaugcuggggucauauuugauuccaagaucaauguguucuuggauaccgaaaccgaaguuuccggacgcugaaaaguuaucccuucucaauucauauucucucacuuugagaccucucuccaauacaauggucggccucagac

SEQ ID NO: 959 - RNA, 228 nt, Artificial sequence
  synthetic construct
gguaaaagacguacccugccguuagugagaacacccugcuucauaggaaaaccuugcuugucguuuccuccugagaucuucagaacguaaccuuuccauucgucuccaagcagaucagcuuccaccuccuggcccaugcguuucucguagaaaauacggaucuuguguucaucuacgaccuccaccaauuuuuggcacccaguugcuggguaagacacguucaacuuc

SEQ ID NO: 960 - RNA, 408 nt, Artificial sequence
  synthetic construct
gaacuacugccuuuugucacuuucaauacauugaaucugacuguuuuggacaaaggucugcauucuccaauggugacuacaucuccaaucucgacgucccugaaacagggcgacaaaugaacagacauguuacgaugccucuucucgaaccgauuguauuuccugauguaaugcagguaaucacgacgaauaacgaugguacgcugcaucuucaguuuuuggacgacuccgguuaggaugcgaccacggaucgaaacguuuccagugaagggacauuucuugucaauguaauguccuucgauggccucacgaggcguuuuaaauccaaguccgacuucacgaugauaucgcaaagauuuacgucucuuggggcccacgccuuuuuuacgguuuaagaaaaucguaggc

SEQ ID NO: 961 - RNA, 401 nt, Artificial sequence
  synthetic construct
gaagcucuucuucgaacuacugccuuuugucacuuucaauacauugaaucugacuguuuuggacaaaggucugcauucuccaauggugacuacaucuccaaucucgacgucccugaaacagggcgacaaaugaacagacauguuacgaugccucuucucgaaccgauuguauuuccugauguaaugcagguaaucacgacgaauaacgaugguacgcugcaucuucaguuuuuggacgacuccgguuaggaugcgaccacggaucgaaacguuuccagugaagggacauuucuugucaauguaauguccuucgauggccucacgaggcguuuuaaauccaaguccgacuucacgaugauaucgcaaagauuuacgucucuuggggcccacgccuuuuuuac

SEQ ID NO: 962 - RNA, 409 nt, Artificial sequence
  synthetic construct
gaacuucuugaagcucuucuucgaacuacugccuuuugucacuuucaauacauugaaucugacuguuuuggacaaaggucugcauucuccaauggugacuacaucuccaaucucgacgucccugaaacagggcgacaaaugaacagacauguuacgaugccucuucucgaaccgauuguauuuccugauguaaugcagguaaucacgacgaauaacgaugguacgcugcaucuucaguuuuuggacgacuccgguuaggaugcgaccacggaucgaaacguuuccagugaagggacauuucuugucaauguaauguccuucgauggccucccugggcguuuugaaacccaguccaacauuucugugcagccuggcaaccuucuuagucuugggaccgacuuugcgguuc

SEQ ID NO: 963 - RNA, 407 nt, Artificial sequence
  synthetic construct
gucacuuucaauacauugaaucugacuguuuuggacaaaggucugcauucuccaauggugacuacaucuccaaucucgacgucccugaaacagggcgacaaaugaacagacauguuacgaugccucuucucgaaccgauuguauuuccugauguaaugcagguaaucacgacgaauaacgaugguacgcugcaucuucaguuuuuggacgacuccgguuaggaugcgaccacggaucgaaacguuuccagugaagggacauuucuugucaauguaauguccuucgauggccucccugggcguuuugaaacccaguccaacauuucugugcagccuggcaaccuucuuagucuugggaccgacuuugcgguucgcgaaaacggucgguuguuuuuggaaagcccucuc

SEQ ID NO: 964 - RNA, 407 nt, Artificial sequence
  synthetic construct
gcuacaucuuccuuggcuccuaaaaucgguccucuaggauuguccccaaaaaaaauuggagaugauauagccaagaauacagccgacuggaaaggucugaaaaucacaguccagcugaagauccaaaacaggcaagccacuauuuccguuguaccuucugcugccucucucaucaucaaggccuugaaagagccuccaagagauaggaagaagcaaaagaauauuaaacacagugggaauaucaguuuugaugaaauuauuuccauugccaagcagaugagaccucgaucgauggcaaagcaacugucuggaacagugaaggaaguuuuaggaacugcccagucagugggcugcaccauugacggaaaaccuccacaugauguuauugacgaaguuaaugaugguac

SEQ ID NO: 965 - RNA, 401 nt, Artificial sequence
  synthetic construct
gccgacuggaaaggucugaaaaucacaguccagcugaagauccaaaacaggcaagccacuauuuccguuguaccuucugcugccucucucaucaucaaggccuugaaagagccuccaagagauaggaagaagcaaaagaauauuaaacacagugggaauaucaguuuugaugaaauuauuuccauugccaagcagaugagaccucgaucgauggcaaagcaacugucuggaacagugaaggaaguuuuaggaacugcccagucagugggcugcaccauugacggaaaaccuccacaugauguuauugacgaaguuaaugaugguacuauagaaguacccgaggaauaaucaauaaacucauuuuuaaguaagaacaaaaaaaaaaaaaaaaaaaaaguaac

SEQ ID NO: 966 - RNA, 401 nt, Artificial sequence
  synthetic construct
gccaaacauucagcgauagucuuaauguuacggaaagcggcuucucuagcuccagugcagagcagccagauggcuugguugacccuucgaagaggcaacagcuucuuaccguacccgcccuaccaauacggguagagucuucacgagguccagaguugaugauggcagacaccaaaaccugaaguggguuuucuccuguaagaagaugaaugauuucgaaggcauguuugacaauucugacagccaucaguuuuuugccauuguuacgaccaugcaucauaagagaguuugucaaccuuucaacgauggggcauugugccuugcggaaccucuuagcggcauaucgaccagcggaaugggguagauacuuugcguucuucucuuucacagcaauauaaucc

SEQ ID NO: 967 - RNA, 401 nt, Artificial sequence
  synthetic construct
gauuggauuuugccacacguuccaguucaucuuucuucuugauagcauaugaauuugaagaacccuucgcugcguugaugagcucgucagccaaacauucagcgauagucuuaauguuacggaaagcggcuucucuagcuccagugcagagcagccagauggcuugguugacccuucgaagaggcaacagcuucuuaccguacccgcccuaccaauacggguagagucuucacgagguccagaguugaugauggcagacaccaaaaccugaaguggguuuucuccuguaagaagaugaaugauuucgaaggcauguuugacaauucugacagccaucaguuuuuugccauuguuacgaccaugcaucauaagagaguuugucaaccuuucaacgauggggc

SEQ ID NO: 968 - RNA, 401 nt, Artificial sequence
  synthetic construct
gaugucucuggucauacccgagaaauuucaacacauccuucguaucuuggguacgaauaucgaugguagaaggaacgugauguucgccaugacggcgaucaaaggagucgguagacgauaugccaauaucguccucaaaaaagcagacguugacuugaacaaacgugcgggagaauguacagaggaagagguagaaaaaaucaucaccaucauguccaacccucgucaguacaaaaucccugacugguuccucaacaggcagaaagauaucaucgaugguaaauacaaccaguugaugucuucgagucuggacuccaagcuccgugaagacuuggagcgcaugaagaagauccgugcccacagggguaugagacacuacuggggucuccgugugagagguc

SEQ ID NO: 969 - RNA, 406 nt, Artificial sequence
  synthetic construct
gaucuuuucguuccaauaaucugacaagaugucucuggucauacccgagaaauuucaacacauccuucguaucuuggguacgaauaucgaugguagaaggaacgugauguucgccaugacggcgaucaaaggagucgguagacgauaugccaauaucguccucaaaaaagcagacguugacuugaacaaacgugcgggagaauguacagaggaagagguagaaaaaaucaucaccaucauguccaacccucgucaguacaaaaucccugacugguuccucaacaggcagaaagauaucaucgaugguaaauacaaccaguugaugucuucgagucuggacuccaagcuccgugaagacuuggagcgcaugaagaagauccgugcccacagggguaugagacacuac

SEQ ID NO: 970 - RNA, 408 nt, Artificial sequence
  synthetic construct
gaaauuuaaugauauuauaggcauccauucgugaccuguaggaacacucuuccuuggguauuuugguugccuugggggccucaaaguuguugggcgaugaaaguggacagagguacggauuuugcggcuguggguaccauuaggaccuuugaugaccuucuuuugcaccuucaacgcuuuggaaauaggagcagaugcggcugauuuuuuaccaacacccuuuugcuguuuaacaggaacauuuuucuuagguuuagcaaucagagccuuagguggagccuuagcuuuaccaggugcagcuuuugcugcaguugguuucuucguugcagguuuggcugcacccuuuguggcuuuaccugccggagcuuuagcaguggucuuugaagcuguagcuuuuguuuugggggc

SEQ ID NO: 971 - RNA, 404 nt, Artificial sequence
  synthetic construct
gauauuauaggcauccauucgugaccuguaggaacacucuuccuuggguauuuugguugccuugggggccucaaaguuguugggcgaugaaaguggacagagguacggauuuugcggcuguggguaccauuaggaccuuugaugaccuucuuuugcaccuucaacgcuuuggaaauaggagcagaugcggcugauuuuuuaccaacacccuuuugcuguuuaacaggaacauuuuucuuagguuuagcaaucagagccuuagguggagccuuagcuuuaccaggugcagcuuuugcugcaguugguuucuucguugcagguuuggcugcacccuuuguggcuuuaccugccggagcuuuagcaguggucuuugaagcuguagcuuuuguuuugggggcagcagc

SEQ ID NO: 972 - RNA, 396 nt, Artificial sequence
  synthetic construct
ggauggguacagcauuauucgaauacggugucccauugccuuggcagguaaauuucuguugaauuuggcucucacugcuccccuuguaccauggggccuaguaauuuuuccccagauggcucguaccuuggauuuuacagacuugggacguccaggaacacacgucuuguuuuuagcuuuauaaacauauacacauuucuugccaacguagaaccagcucucaucuuuugauucaguuccuuccacauucaaaagagcaguauucucguguugauuacgaaguccucguuuguaaccaguaaauauugcuuuggcguauaaccuaccaugucuuuugauuggccuucuuuuaauugaaacuuuuuggucugacguuucuuuaucgacuuucugguc

SEQ ID NO: 973 - RNA, 406 nt, Artificial sequence
  synthetic construct
gcauuauucgaauacggugucccauugccuuggcagguaaauuucuguugaauuuggcucucacugcuccccuuguaccauggggccuaguaauuuuuccccagauggcucguaccuuggauuuuacagacuugggacguccaggaacacacgucuuguuuuuagcuuuauaaacauauacacauuucuugccaacguagaaccagcucucaucuuuugauucaguuccuuccacauucaaaagagcaguauucucguguugauuacgaaguccucguuuguaaccaguaaauauugcuuuggcguauaaccuaccaugucuuuugauuggccuucuuuuaauugaaacuuuuuggucugacguuucuuuaucgacuuucuggucgacuuuuuucuucuugccuac

SEQ ID NO: 974 - RNA, 416 nt, Artificial sequence
  synthetic construct
gucucuucaacucuaccuugacauuuuucuccuuagcuucucugcgaagcuuuucguuggacuucacucgcugcaagaaauccucccugcacuucgaaugggugacguguucaauacggauauuaauucucuuggggaugaucuucccccgaacccuuuuguuuacgauuacucccagcgcgugugcuguaacguuaaauacacggccgguccuuccgugguaggcuuuauagggcaugccuuuuugaaccgcuccauuucccuugauaucuacuaugucuccaacuuuauagaccuucauauauguggagagcgggaugacuccaugcuugccgaauuuacgggcgaagagaucccucguaccgcgacgguaaccuuuggaguucgucauuuuacagaccuuuccacacuucuuc

SEQ ID NO: 975 - RNA, 403 nt, Artificial sequence
  synthetic construct
gcuuuucguuggacuucacucgcugcaagaaauccucccugcacuucgaaugggugacguguucaauacggauauuaauucucuuggggaugaucuucccccgaacccuuuuguuuacgauuacucccagcgcgugugcuguaacguuaaauacacggccgguccuuccgugguaggcuuuauagggcaugccuuuuugaaccgcuccauuucccuugauaucuacuaugucuccaacuuuauagaccuucauauauguggagagcgggaugacuccaugcuugccgaauuuacgggcgaagagaucccucguaccgcgacgguaaccuuuggaguucgucauuuuacagaccuuuccacacuucuucgauagaaaaaaagaaaccaacaaagauggagaaac

SEQ ID NO: 976 - RNA, 402 nt, Artificial sequence
  synthetic construct
gaauucauacggaaucggcgcuagcuucacggcaggcaccuuuccgcugacgaugugugcaggccugggcugggcaggcugucucuucaacuccaccuugacauuuuucuccuuagcuucucugcgaaguuuuucguuggacuucacucgcugcaagaaauccucccugcauuuagagugggugacguguucaaugcggauauuaauucucuuggggaugaucuucccccguacccuuuuguucacaaucacuccgagugcgugugcgguaacguuaaauacacggccgguccuuccgugguaugcuuuguagggcaugccuuucugaacugccccauuuccuuugauaucuacaauaucuccuacuuuguagacuuucauauauguggagagugggaugac

SEQ ID NO: 977 - RNA, 403 nt, Artificial sequence
  synthetic construct
guuuuucguuggacuucacucgcugcaagaaauccucccugcauuuagagugggugacguguucaaugcggauauuaauucucuuggggaugaucuucccccguacccuuuuguucacaaucacuccgagugcgugugcgguaacguuaaauacacggccgguccuuccgugguaugcuuuguagggcaugccuuucugaacugccccauuuccuuugauaucuacaauaucuccuacuuuguagacuuucauauauguggagagugggaugacuccaugcuugccgaauuuacgggcgaagagaucccuugugccgcgacgguaaccuuuggaguucgucauuuuacagaccuuuccacacuucuucgauagaaaaaaagaaaccaacaaagauggagaaac

SEQ ID NO: 978 - RNA, 407 nt, Artificial sequence
  synthetic construct
gcccuuccacacuguccuggucgagacgccaagcaagccaacaaccuuccaguugugaauugcucuucgauagcagguucuacuuuagaagucuucugacgaguuucguacuucuuuuguacuuucuuacuacguuucuucgcuaaaagagccucuucuucggcagucaguuuggcucccuucuugcgacccaaaggcaggauguaaugauucucauaccacauucugaauggaguggcaucuacaacaacuauugcauucuucacuaauguuuugguacgcaccaacucauuguugcuagcauuguagacaacaucaauaauacggguuuuucucgcaguuccuucacuaccccaggcaaaauuuccagugucgagccuuagagcccuauauuucaaauuaccacc

SEQ ID NO: 979 - RNA, 415 nt, Artificial sequence
  synthetic construct
gaacucuaauucuuuuccuucuaaaauguagccaucugcccuuccacacuguccuggucgagacgccaagcaagccaacaaccuuccaguugugaauugcucuucgauagcagguucuacuuuagaagucuucugacgaguuucguacuucuuuuguacuuucuuacuacguuucuucgcuaaaagagccucuucuucggcagucaguuuggcucccuucuugcgacccaaaggcaggauguaaugauucucauaccacauucugaauggaguggcaucuacaacaacuauugcauucuucacuaauguuuugguacgcaccaacucauuguugcuagcauuguagacaacaucaauaauacggguuuuucucgcaguuccuucacuaccccaggcaaaauuuccagugucgagc

SEQ ID NO: 980 - RNA, 251 nt, Artificial sequence
  synthetic construct
ggugaagugacaaagugauguucuuagaauuuguuuugaaaauauuauuugcagguaauaauaaugaacaguaugauaugaacaaguguguguuugugauuuuuggaaaguaccuugaaaccuagucaauugaaauuggguugaguucucaguucgcaugaguucuguccgauucaucaaauagaaaguggcaaaaucuuucauaucuaacgugauuuucuuuucucuaaaaccaccgagcuuuuugaugc

SEQ ID NO: 981 - RNA, 243 nt, Artificial sequence
  synthetic construct
gugcuguuuacgucugaaacugcaaccuucggugagucucgcuuugccuccgguagaugugcagaggaucguugaacauccuuugcaggguacugcggacugggcgugcgagaaaauugucgaaauggcguaacaaccagggcauuuuacauccaugaaguaacuguuggggugcuggaccaaccuuuugaguuugugagauuuucucugcuguucggcagaaggaugcaauaagucgacugc

SEQ ID NO: 982 - RNA, 215 nt, Artificial sequence
  synthetic construct
gaaguauguucuugguuuacgaacugagaagcgguucauagauuuguguugaauacguuuuggaagugggaaacgaaucuuugaaucguggaacuguuuaacuuguggucuccuugugucacuugccuugacuucuucaacuuugauaaucuguauagcaugagcucuggcucugugacgggccccauaucucuguagcaagaaguuacagcucc

SEQ ID NO: 983 - RNA, 192 nt, Artificial sequence
  synthetic construct
gcucucauacuggaccugcgccucuuggcgauuucccuacgggccuucgauuccuucuugcguugagcuagcaauuuggcguaugcaucuucuuguucuuugcguuuaagacaacguuucuucuugagagccaaacggugacguuuucuuugcagaacgacuggaguaaucaaacguuggauuuuuggagcc

SEQ ID NO: 984 - RNA, 405 nt, Artificial sequence
  synthetic construct
guauaaagguaaaaccucauccuuagguucagcaacagaaauguugucgggcaaagguuucuugggaccaauuuugccuguggcaucauaaggcaacaugaucuuaacuuuuauucccagcacucccugucgcagcaauacguggcggguggcagugucuacauagucauugcauggaucuccugaaugaaucaugagaccaucuacgaauuucauagauuuugcucucugaccacguaguuuuccagauacaacuacuucacacccuuuagcuccacauuccaugauauaccucugucucuuacagcaagaccuccaauaagcuugaaccucaaggauucugccugggcgauagcacacaaaccacgguuugcuacuuuuucuccguacaaaacaacggaguuc

SEQ ID NO: 985 - RNA, 403 nt, Artificial sequence
  synthetic construct
gcaacaugaucuuaacuuuuauucccagcacucccugucgcagcaauacguggcggguggcagugucuacauagucauugcauggaucuccugaaugaaucaugagaccaucuacgaauuucauagauuuugcucucugaccacguaguuuuccagauacaacuacuucacacccuuuagcuccacauuccaugauauaccucugucucuuacagcaagaccuccaauaagcuugaaccucaaggauucugccugggcgauagcacacaaaccacgguuugcuacuuuuucuccguacaaaacaacggaguucucggggaaacggaaucucuuuugcacaacugaaguuaacucgcggauucuucuguucuucucgcccaagacucugucuguucucguugcc

SEQ ID NO: 986 - RNA, 403 nt, Artificial sequence
  synthetic construct
gcuucuauuaaaaguguuugugguaggcugugugagcugcagcccgcuaauguuguugaacuccaacauuuucaacauuuccuuggucucugggucgaccucaaugaugucguguuccagagcagauacuucaggaacgaaguugucacgucgcucacgcucuucuuccuggagcuugauggaaauuccucuaaccugagaaugacggagccucuucaucaaaugcgugacgaauccggcaaccuuguugcgaagagguuuggugguaaugaucgcaacuucuucgcauauccguuuauugguguggaaaucuaacgucaaucggguauaguauuuuucgaugaucaauuuggaagcuuuuuucacggucuucguacguacacgacccauguuugagaaauuc

SEQ ID NO: 987 - RNA, 393 nt, Artificial sequence
  synthetic construct
gaagaagaauccgaggauuuugccucccaaguguuuccuucuagcuucuucaugguccauaaugccaccacuaguagucaauacgacauauccaaacugacgugaggggaguaaauuauucguccacuuuucaauguguguaaugggcacaucaaaccuaggugaaauuacuccacauuuauugauucuuccuguuaaauuaacuacgaucuucccacuccuauggucgucuacaauuucaaauucuccaauauaaccguguuucaucaucacagucaggaauuuuaccacuacuuuggagcaaggccggaugaguaccugucucuugccucgcuucucagcauuguuuauagauuuuaaggcaucacucaauacauucauucgcaccauggc

SEQ ID NO: 988 - RNA, 396 nt, Artificial sequence
  synthetic construct
gaugaugucggacuuuccuaauuugucuucgaugauuugauugcuagugauuggcacccuuuggccguucaccuuggcgaaaccucucuuauaaaucaguucucugacagauuucaaguuaggguauccccaagugauguaagguucgcauauucugagcauguugaugguagcuuuguugagcuugacaaagacaccauuguugauuugaaggagccggaacaauuggagaaccuugcguacuuuaggagcuacuuuguugauacccuuuauacgaauuacgaaugccaacuuggcuucagcgggaacguaaaaguuuccucugguuuuagcuugucggaucaaccuaacuucaucucuuucuuugagccgguauucuuuaacauacuguucggc

SEQ ID NO: 989 - RNA, 397 nt, Artificial sequence
  synthetic construct
gaugaugucggacuuuccuaauuugucuucgaugauuugauugcuagugauuggcacccuuuggccguucaccuuggcgaaaccucucuuauaaaucaguucucugacagauuucaaguuaggguauccccaagugauguaagguucgcauauucugagcauguugaugguagcuuuguugagcuugacaaagacaccauuguugauuugaaggagccggaacaauuggagaaccuugcguacuuuaggagcuacuuuguugauacccuuuauacgaauuacgaaugccaacuuggcuucagcgggaacguaaaaguuuccucugguuuuagcuugucggaucaaccuaacuucaucucuuucuuugagccgguauucuuuaacauacuguucggcc

SEQ ID NO: 990 - RNA, 403 nt, Artificial sequence
  synthetic construct
guuaauuuaacuccuuuuccucuugguagagaaacgaaggccuuagcaccuuuuccgaugauaaaaacauuauucaaccuaguagcgaaaacauggccauuggcguccuuaacguguacaaugucaaaggaaccuggaugacguucccuauugaugaccguaccaacacgacccaaauuccuuccuccaguuaucauacauaaauuuccagauucgaauuuuauguaaucgaggauuuugcaagaggcaaucuccaacuggauggugucguugaccuugauguuugggucaggauaacggaugguacguccgucgugugucacuaugaagggaauuccuuuggggccaguuugcauccuccugacuuugcauaguuuguacuuugcuuccucagcaguaauac

SEQ ID NO: 991 - RNA, 408 nt, Artificial sequence
  synthetic construct
gucucuuucuucugcaauuguuaauuuaacuccuuuuccucuugguagagaaacgaaggccuuagcaccuuuuccgaugauaaaaacauuauucaaccuaguagcgaaaacauggccauuggcguccuuaacguguacaaugucaaaggaaccuggaugacguucccuauugaugaccguaccaacacgacccaaauuccuuccuccaguuaucauacauaaauuuccagauucgaauuuuauguaaucgaggauuuugcaagaggcaaucuccaacuggauggugucguugaccuugauguuugggucaggauaacggaugguacguccgucgugugucacuaugaagggaauuccuuuggggccaguuugcauccuccugacuuugcauaguuuguacuuugcuuc

SEQ ID NO: 992 - RNA, 404 nt, Artificial sequence
  synthetic construct
gacuucaaaggaguuguaaaaauuaucgcugaaauucaaaagucugacuugaaaggaguuguaaauaaacuucuuccugacaguauagcuaaggauauugagaaagccugccaggguaucuauccucuucacgacguauacauccguaaagugaaaguuuugaagaaaccccguuucgaacuguccaagcucuuggaguugcauggugauggcgguaaaggaggaucuggugaacccgguggugaugcuggcucuaaaguugauaggccugaagguuaugaaccaccaguacaagaaaacguuuaaacuuuuaaagaauguuguaauaaaacuggaaaagaaguaaaugcgaaguauuuuugagugcaacagagaaacuaaaaguaaacuuuccacguaauuuc

SEQ ID NO: 993 - RNA, 401 nt, Artificial sequence
  synthetic construct
gguugaaaaaauuaucgcugaaauucaaaagucugacuucaaaggaguuguaaaaauuaucgcugaaauucaaaagucugacuugaaaggaguuguaaauaaacuucuuccugacaguauagcuaaggauauugagaaagccugccaggguaucuauccucuucacgacguauacauccguaaagugaaaguuuugaagaaaccccguuucgaacuguccaagcucuuggaguugcauggugauggcgguaaaggaggaucuggugaacccgguggugaugcuggcucuaaaguugauaggccugaagguuaugaaccaccaguacaagaaaacguuuaaacuuuuaaagaauguuguaauaaaacuggaaaagaaguaaaugcgaaguauuuuugagugc

SEQ ID NO: 994 - RNA, 319 nt, Artificial sequence
  synthetic construct
gugaguagccuguuuacgcauuugaguaaggauguuugaaaguucuucacgcuuccucuuggcacggaugugcgugccaagacgucucuugaggaacuuaagugcccuuuuaucuuucgaaaccuucaacaauuccauggcucucuucucauaaggggcaugaccuacaacuucucggauaauaucacgaacgaacuuugugugcuuuguuuggauccccuucaaccucgcgggacgaacuuuguugaucuuuuugucgauuuuugugguuuuguguccccuuuggagcccaacggcgauuucguaccuuggggccauc

SEQ ID NO: 995 - RNA, 272 nt, Artificial sequence
  synthetic construct
gauguguauaagagaccuucacggaauccauuacggaagcgacgacguacaauuuucaaaugacggagucggccgguuccaguggucuuccuccucuuagcuuugauugaccaguuauaagaacgcaauuuugcagauggguauccacacugggcacauugagacuucugaauaugauaggaugaucggccacaucuccuacacaaugugugagucuuguugcgacguuuaccaaaacuugacguaccuuucgucauuuugacagacuuucc

SEQ ID NO: 996 - RNA, 260 nt, Artificial sequence
  synthetic construct
gggccuucacggaauccauuacggaagcgacgacguacaauuuucaaaugacggagucggccgguuccaguggucuuccuccucuuagcuuugauugaccaguuauaagaacgcaauuuugcagauggguauccacacugggcacauugagacuucugaauaugauaggaugaucggccacaucuccuacacaaugugugagucuuguugcgacguuuaccaaaacuugacguaccuuucgucauuuugacagacuuucc

SEQ ID NO: 997 - RNA, 407 nt, Artificial sequence
  synthetic construct
gcuccuuagcuuucacuugggcugcgauacgaucuagaucucuccuaccuuguuggguaaguuuccuaccaccaucagaugauuuuucaaucaacuugagagcuuccaagcuuugcagggccuugcgagcgauacuuccggcggaccugcagaagugggaagguuugguuccguuacguuugcggguuccaaagauuuucgugacugaaccuacaccgacgggugagcgaauguagauaugccuagcaauggcagaacaucugauguaguaccaaucgggaucauagggagccaauuccuuagcucuugagguuuuuacaagauccacccauucugguacacguaguuuaccaguuuuuuucaggaaauaggcgaaagccuuuacgaauuuguguuggucaacgucc

SEQ ID NO: 998 - RNA, 403 nt, Artificial sequence
  synthetic construct
guauaagagacgaugcuuuaagagccuuucgcuccuuagcuuucacuugggcugcgauacgaucuagaucucuccuaccuuguuggguaaguuuccuaccaccaucagaugauuuuucaaucaacuugagagcuuccaagcuuugcagggccuugcgagcgauacuuccggcggaccugcagaagugggaagguuugguuccguuacguuugcggguuccaaagauuuucgugacugaaccuacaccgacgggugagcgaauguagauaugccuagcaauggcagaacaucugauguaguaccaaucgggaucauagggagccaauuccuuagcucuugagguuuuuacaagauccacccauucugguacacguaguuuaccaguuuuuuucaggaaauaggc

SEQ ID NO: 999 - RNA, 407 nt, Artificial sequence
  synthetic construct
gccuuucgcuccuuagcuuucacuugggcugcgauacgaucuagaucucuccuaccuuguuggguaaguuuccuaccaccaucagaugauuuuucaaucaacuugagagcuuccaagcuuugcagggccuugcgagcgauacuuccggcggaccugcagaagugggaagguuugguuccguuacguuugcggguuccaaagauuuucgugacugaaccuacaccgacgggugagcgaauguagauaugccuagcaauggcagaacaucugauguaguaccaaucgggaucauagggagccaauuccuuagcucuugagguuuuuacaagauccacccauucugguacacguaguuuaccaguuuuuuucaggaaauaggcgaaagccuuuacgaauuuguguugguc

SEQ ID NO: 1000 - RNA, 372 nt, Artificial sequence
  synthetic construct
ggcaucugcaaugguaacuucaacuucuacaccagguucaauguugauggaaguuaucugcuucacgauuucagauggugaaugcaagucuaugacucucuuguggauacgcaucuggaaucugucccaaguuuuugaaccuucuccacaagguguuuuacguguagugaugcgcaaaaucuuggugggcauacguacuggucccuuuacuuucagcuuuugcuuuuuggcugcaucgaugagaucagaacaaacuuucuccaaggagcgaacauuacgugaaguuaaaguuauccuaaugugguggauuggagcaaugucuuguccagguuuuucuggauugacuucuuuuguggaugucauuucgauuac

SEQ ID NO: 1001 - RNA, 367 nt, Artificial sequence
  synthetic construct
guuuucugcgcaauugcagagaguuucgucugagccaggcagcucgucuggaaccacccuuuguuugggaauaucugugucccuugcccaaaccacgugaagacuuuccugcagacguuuuaccacguaguucacgguguuuguggacagcauucacuauccaauuaacuuuaggaucacgacgaauugcguuaugugaugggucaaccagaauaacuucaaaauauuuauaagaagaguccugagcaacccaguaugaguuaagaacucucaauccaccacaucuucuucccacacguuccucagcaauagcuugcaaguuacggacagguuuuaauucauuuacuccgugacucuuagguuuacc

SEQ ID NO: 1002 - RNA, 296 nt, Artificial sequence
  synthetic construct
gcuuugagugcaaauuuccuuggagggaaugcagaacgcuugcggauuuccuuaggagucuugaugcguugcucauguugagauagagcacgacgaauagcacgugucuucuuaggucucaaauccaaagguauguauuucuuauucuuguacaacuuucuuaaauuuuccuuuugcuucuggugcauaacaauguauacacgagcaauugcuuugcggacuacccggauuuuugaaaguuuugaaggggcuccuccagugacuuuagccacccucaaacugguaaguuccguucc

SEQ ID NO: 1003 - RNA, 291 nt, Artificial sequence
  synthetic construct
gcuuugagugcaaauuuccuuggagggaaugcagaacgcuugcggauuuccuuaggagucuugaugcguugcucauguugagauagagcacgacgaauagcacgugucuucuuaggucucaaauccaaagguauguauuucuuauucuuguacaacuuucuuaaauuuuccuuuugcuucuggugcauaacaauguauacacgagcaauugcuuugcggacuacccggauuuuugaaaguuuugaaggggcuccuccagugacuuuagccacccucaaacugguaaguucc

SEQ ID NO: 1004 - RNA, 369 nt, Artificial sequence
  synthetic construct
gaaauucuuugcaagaauuccaucuuucuuuguuaaccuaacaaugcaaucgucugauucucccauucgucugauugcuccgcagagggcauaacuuuugaaaccuucagucauccugccgguuugagggucaacuucggcgauacucagcuggauugaagcauggucuuuggcgugaaugauccuguuacuagcagaacacuuccuaggacaguauaaaucaacgguuucuccugcaucauuuuccauuuugagaggauuuucuuccuuuaaacgaugagaaacagcaaauggucgacaaauuaaagagagagacaagaaugcaauuucagcuaacucuucuacucuucuucuucuaucacuaugcuc

SEQ ID NO: 1005 - RNA, 178 nt, Artificial sequence
  synthetic construct
guccaacuucuugaauccaauauucaaugcauauucucugaaacacugccugcaaagauucaguccauacuuccuuauuaaaccaugccuguuugagcaggaacggcaggaucuugagccuuguccguauuuacgaggaugagagaaccaaauauuuucaaaacccauuuuugugaac

SEQ ID NO: 1006 - RNA, 190 nt, Artificial sequence
  synthetic construct
guagccaucugcccuuccacacuguccuggucgagacgccaagcaagccaacaaccuuccaguugugaauugcucuucgauagcagguucuacuuuagaagucuucugacgaguuucguacuucuuuuguacuuucuuacuacguuucuucgcuaaaagagccucuucuucggcagucaguuuggcuccc

SEQ ID NO: 1007 - RNA, 250 nt, Artificial sequence
  synthetic construct
gguuuuccaaagguggcaagaaaggagugaaaaagaagauuguagacccguucacaagaaaagauugguaugaugucaaggccccgucaauguuugccacccgacagguuggcaaaaccuugguaaaccguacccaagguaccaagauugccucugaagguuugaaauccagaguguucgaaguaucccuugcugacuugcaaaacgauaaugaugcugaacgcuccuucaggaaguuccgucuuauugc

SEQ ID NO: 1008 - RNA, 411 nt, Artificial sequence
  synthetic construct
gcuuucauuacauucuuguuggcuuucuguuuaggugcugccuuaguuuuugcuggggcugcugguuuuuuggugguugguuuagugccuuucuucuguuccuuugcagcacggauagcuuguucccuuugugcuuuccucacuucgggccucugauuccucuuggccaugaugucauucagagaugcuccuacaauagcucgcuggaauuuuugaguucuccuaguucgcuuuuuuguggccucuucuuccuggcccuuccugugcuuacgucuguacaagacaguccaaguuacuuuacgaggauuccucuugagaaggugagcccguucacauuuugaguugaggaaggugaaugucuuuccaucaacuuuaaccauaguuuuuccauggccuggguaaauuuuauac

SEQ ID NO: 1009 - RNA, 268 nt, Artificial sequence
  synthetic construct
gauuugggaaacauguccuccaccauuuacacggacucucacaucuacugcagagaacuuguccuuuccaagaagcaaaauggguucuugaaguuuguccuggagcauuuuaggcucaaccuggcucaaagggcgcccauugacccuuaguacuccucuaccccuuuugcaauaugcaacugcgguagcuguuuuuuuucugccaaaaacuuggacagaguggauugguuccuuuuucggcuucuguguaggcgccugcauuguggac

SEQ ID NO: 1010 - RNA, 250 nt, Artificial sequence
  synthetic construct
gcuuuuggugaggcgcaaaacuugcacugcaguagcucuuacccagguugauucuggugacagguccaacuucaacaagguuguggaggucaucaaaaccaacuucaaugaccgcucagacgaaaucaggagacacugggguggugguuuguuggguuccaaauccgcagcucguaucgccaagaucgaaagggccagggcuaaggaacucgcccagaaacaggguugagauugguaacuaguuguauuc

SEQ ID NO: 1011 - RNA, 223 nt, Artificial sequence
  synthetic construct
gggugcagcggcaccagucuucuuggugagguucuuccucuuaacacguccaggacggccaccaccgaauggagacuucagugagaagucgauguguuucugagaguccaaacggacaagaaaagagggaauguucacaacuuguuugcgaacucgaaugugucccugucguaucagaacccuggcaugauggauagauuuugccaauccagacuugaaaacc

SEQ ID NO: 1012 - RNA, 401 nt, Artificial sequence
  synthetic construct
gcugcccagucagcaguuucauugguauuccagucaauaucugguggauccagaggagcagcaauuucaguggguuuaacaacugcugcaacagccucuuuggcagcuuguucuuccuuuucugccucuucagguucucuguagaagaauagaucgacuacaaccucccacuugguaucgcguugaauaguuccucgaagacgcaggaccucacgagcuaauagccaccagagaagaccaauacuguguggagacuuguuauugccaggaauagcaaugucgacaaaucucaaaggagaaucaguauugcacaaagcaaugacuggaauguugacauaagaagcuucaguaaucggcugaugaucaaaggcuggaucaguaacaaucaauaaacgagguuc

SEQ ID NO: 1013 - RNA, 405 nt, Artificial sequence
  synthetic construct
guauauguagggguugcgccagguacuacaggagcaacugcugguaccucagcugcccagucagcaguuucauugguauuccagucaauaucugguggauccagaggagcagcaauuucaguggguuuaacaacugcugcaacagccucuuuggcagcuuguucuuccuuuucugccucuucagguucucuguagaagaauagaucgacuacaaccucccacuugguaucgcguugaauaguuccucgaagacgcaggaccucacgagcuaauagccaccagagaagaccaauacuguguggagacuuguuauugccaggaauagcaaugucgacaaaucucaaaggagaaucaguauugcacaaagcaaugacuggaauguugacauaagaagcuucaguaauc

SEQ ID NO: 1014 - RNA, 232 nt, Artificial sequence
  synthetic construct
guucuuuauuuucccuaagucguuucacagcagaccugacugaagcagcagcuguuguggaauauacccaggcuccuccagcuacaacucgcuugcaacguuugcaagaccaaaugccaacacaacuccucuucauggcauccuuuccacaaaaacugcaggaauauuuacuguguugagugauuuccaucuucuucaccaucuuacgaagugaggcaccauaucugguucc

SEQ ID NO: 1015 - RNA, 321 nt, Artificial sequence
  synthetic construct
ggaaugccugcagagaaagcgacucaauacaagcaggcgacuauuccaaagaagccucgcaucaagaugacaagagguguacagaccgagacaagaaugaagguuguggacaacucuggagccaaggaggucaaggucauuggugucaagggcuuuguuggccgcuugaacaggaucccaugugcagcaccaggagacgugcuugugugcucggucaagaagggaaagccaacccucaggaagacgguuguguguguugugcucauuagacagaagaagauuuggaaaagaaaggacgguuguaacauaugcuuugaggac

SEQ ID NO: 1016 - RNA, 266 nt, Artificial sequence
  synthetic construct
gaaaagaagucugagcagaucaaaaacgcaaagauaucuucaagagggccgaacaguauguuaaagaauaccggcucaaagaaagggaugaaguuagguugauccgacaagcuaaaaccagaggaaacuuuuacguucccgcugaagccaaguuggcauucguaauucguauuaaggguaucaacaaaguagcuccuaaaguacgcaagguucuccaauuguuccggcuccuucaaaucaacaauggugucuuugucaagcucaac

SEQ ID NO: 1017 - RNA, 355 nt, Artificial sequence
  synthetic construct
ggguagccuguuuacgcauuugugugaggauguuggacaguucuucacgcuuucucuuggcucggauguguguuccaagacgucucuucaggaauuugagugcucguuuaucuuuggaaacuuuuaacaacuccauggcccucuucucauauggggcaugucccacaacuucucggauaaugucucgaacaaauuucguaugcuuaguuuggauccccuucaaccucgcaggccgaacuuuguuaaucuuugacuuaucaaguuuggugguuuuguguccccuuugaaguccuacagcuaucucguaccuuggagccaucuuaaccuuuacaccuaaaauuguacacgugucuuc

SEQ ID NO: 1018 - RNA, 255 nt, Artificial sequence
  synthetic construct
gaccaaucgacgaagaagugcauuaccuugaaacaaucuuuuagguucuuucucaucuaaaguaagcaguucucuagcagcuuuacggauuuuagcgagaacauauuuaacucuccauacuucacgcuuguugcgaaguccgaaagcaccaauuauuuucaacuccugauccaaacgugcuuuuucauaaggacgccugggaguuacauaugucuuggagugaaccgaaggaacccucccguuuaccauuuuggc

SEQ ID NO: 1019 - RNA, 397 nt, Artificial sequence
  synthetic construct
guuguugcugagcgcgauuguugucucguccagggaaauuucucugagguggaguucugauccuccuguccuucuugcuucuauuacguacuacuuuacuguggaucgcacacgaaacgcaguaguguagcuuggcguaaaguuuuggaagaacguauugaguauagacugaagcuucggugauaucccuuacagcugcagcuucaacaauguuacgaauaacaaauuucuugauggcuuuauccuuaggaacacaucuugcacaauuggugcaacgaacuggcuuuacaugaccucggccguguuuugaacguccuccauugcgccuuuugcaagucauuuuuacagcuuuccaacucuguugcacggauguaaaagagcugucaaaauugugagc

SEQ ID NO: 1020 - RNA, 353 nt, Artificial sequence
  synthetic construct
gcuuguugggccuuaagaacuuuaacaacaaucuuuuguuccucgaugagaaagcucucacgaucuuuuccuuaacacauuuguggcacaaaacuccaccguaugcccucuucacggucuucuuccuucuacauaaacgagaccguucuuguggacgggcugguaagauaccucuuagcuugucuuugcacugaccacaucuaggaaucuucuugggcuuuuucaaguacugguaaacuaauuuuccaccaggaguucugacgauaguucuccuguuagauuuaguauuguacgacaaucgucgccugaagacaagucguuggaccauuguguccugaaaugaaaaaagucuc

SEQ ID NO: 1021 - RNA, 407 nt, Artificial sequence
  synthetic construct
gaacuuugcuuugacaaugacgggcuggucgggcaggcgcccuuuacccaaaagcuuguaguauccagcuuuaacaaugucaauuacaggugccuuucccucgggauggucuuuguacugcagccuugucuguucacuaacgaguguccacaguuuguccagauuuaucgcuggggaccauuuggaguuucgccucaaaugguaguuacgcauaccgagcuuuccaaaguauccaggaugguacuugucaaaguuuauccuguggugaugcauaccaccagcauuaccacgaccuccaggaugcuugcggugcuuaccaauacguccauguccauggcuuacguguccccuuaguuuccuagucuucuuuuugugggucgacauuuugguagagaaaugaaggaauc

SEQ ID NO: 1022 - RNA, 402 nt, Artificial sequence
  synthetic construct
gcuggucgggcaggcgcccuuuacccaaaagcuuguaguauccagcuuuaacaaugucaauuacaggugccuuucccucgggauggucuuuguacugcagccuugucuguucacuaacgaguguccacaguuuguccagauuuaucgcuggggaccauuuggaguuucgccucaaaugguaguuacgcauaccgagcuuuccaaaguauccaggaugguacuugucaaaguuuauccuguggugaugcauaccaccagcauuaccacgaccuccaggaugcuugcggugcuuaccaauacguccauguccauggcuuacguguccccuuaguuuccuagucuucuuuuugugggucgacauuuugguagagaaaugaaggaaucuauuuuuucgguguugcc

SEQ ID NO: 1023 - RNA, 285 nt, Artificial sequence
  synthetic construct
gggacaauguacccaggugaaaguugaauucauuggugaacaaaaccgacagaucaucaggaacguuaaggggaccgucagagaaggugauauucucacguugcuggaauccgaaagagaagcuagaagacugagauaacuauuuugcaguuuuuuccaucuguaagcauuguacuguuuaaaacucucauauugugaaaaaaaguuagugaagacacgaccgaagaagcaauuguauggcgaaacacguuuaauuuuuguaaaaccguuuaguaaaaaugucac

SEQ ID NO: 1024 - RNA, 235 nt, Artificial sequence
  synthetic construct
gauucacgagcugcuuuccuuucuacagcucguuugaguugcuguuugguacucaaguugugccucuuggagaaucguugguuccucaagaauuuggcauccauccccagaguugauucauggcgaaaccuuuugggcuuuuugauuccauuacggugggcuuugcgguuuugauuaugauugguaugauucuuugacuuugccauugugaaacuagugcgauagaauuuucuuc

SEQ ID NO: 1025 - RNA, 404 nt, Artificial sequence
  synthetic construct
gccuuggucuuuuuggcaggaaggggcuucugugaccuaaguacugcgcuugcccuacgaagagcggccuuaguaaggucugugcgguacuuauuugcuuucaaaagacgcuucaacuuguagagggaucgccugggaccagauuucauuguccucuugacagugcuuuguuuggguuugcgcuguuuacuggcuuuuuuguaaacaacugugaaacccuucuugucagcugcaucuacuaugccuacagauuuuuuguggaugauuccauuauaucuauaggaacugagauuugucaaguuauuggguuccguacugaaugguuuggaaauguuccuuuucuucaauagaaaggcguuauuguuucggauaauuccccaaacuaaaugugacgacauuuuggc

SEQ ID NO: 1026 - RNA, 393 nt, Artificial sequence
  synthetic construct
gccuuggucuuuuuggcaggaaggggcuucugugaccuaaguacugcgcuugcccuacgaagagcggccuuaguaaggucugugcgguacuuauuugcuuucaaaagacgcuucaacuuguagagggaucgccugggaccagauuucauuguccucuugacagugcuuuguuuggguuugcgcuguuuacuggcuuuuuuguaaacaacugugaaacccuucuugucagcugcaucuacuaugccuacagauuuuuuguggaugauuccauuauaucuauaggaacugagauuugucaaguuauuggguuccguacugaaugguuuggaaauguuccuuuucuucaauagaaaggcguuauuguuucggauaauuccccaaacuaaaugugac

SEQ ID NO: 1027 - RNA, 402 nt, Artificial sequence
  synthetic construct
guuguacuuccuuuauguccuuuucuuguuccaauucucugccuuuucuuaaccucugcauaauauaagcuuucugucuuuucugcuuaauaauuucuacuuucuucauggcuuccacugcuuuggugaaagucucucugucguacuuaacaggaaucugucuacgcuucucaaacucaaaggcaggaucaauugacaauuccuuuccgacauucuuucuauaugcuuucguccauuugacuuuacggggauucuuuuucuuuuugaaugcagcaugacauuuagaccuacagaaucugaauaucuuguuaucauuccugacgaauugaauaccauguccaggauagauccuugaugaacaaaaauaacaugucucaauacgcauuuugauuuuuauauacc

SEQ ID NO: 1028 - RNA, 446 nt, Artificial sequence
  synthetic construct
gucaccucaccaccaucuucaacaauucccuccauuucuucaucacuuuccucaaugcucucuuucugguccucuuugcguuguuucaacccagcugcuggugaacggaugagugaaagaucucguuguacuuccuuuauguccuuuucuuguuccaauucucugccuuuucuuaaccucugcauaauauaagcuuucugucuuuucugcuuaauaauuucuacuuucuucauggcuuccacugcuuuggugaaagucucucugucguacuuaacaggaaucugucuacgcuucucaaacucaaaggcaggaucaauugacaauuccuuuccgacauucuuucuauaugcuuucguccauuugacuuuacggggauucuuuuucuuuuugaaugcagcaugacauuuagaccuacagaaucugaauaucuuguuaucauuccugac

SEQ ID NO: 1029 - RNA, 417 nt, Artificial sequence
  synthetic construct
guaucucucuucaaauuuaacucugguuuggaaccuaaucuucuuccucuucacuggauccuugaggucuuugggcgccacuuucaaguccgaagucaaauccacugaauaucuuguaggcaucaaaugguuauaguugagcaccuuaaggaagggcuugauuuuggaccucuugugcauuuuuccuuugcccauacguuuguggauuuuucuaggguaccuaucgauuccagccaccacggcauguccauauuguuuaucugacgucccaucaucguaauuuuuuaugacuacugcuuuucuuccagcguaucggccuccaaggaccaauacgacuuuaccagauuucauuauuuuacccauuuugaucugaaaauaaaaauguucauaaccuaaaaaauuacuaucacuguauac

SEQ ID NO: 1030 - RNA, 414 nt, Artificial sequence
  synthetic construct
gaaccuaaucuucuuccucuucacuggauccuugaggucuuugggcgccacuuucaaguccgaagucaaauccacugaauaucuuguaggcaucaaaugguuauaguugagcaccuuaaggaagggcuugauuuuggaccucuugugcauuuuuccuuugcccauacguuuguggauuuuucuaggguaccuaucgauuccagccaccacggcauguccauauuguuuaucugacgucccaucaucguaauuuuuuaugacuacugcuuuucuuccagcguaucggccuccaaggaccaauacgacuuuaccagauuucauuauuuuacccauuuugaucugaaaauaaaaauguucauaaccuaaaaaauuacuaucacuguauacaaauuuugcuaaaauaacuaugaaauc

SEQ ID NO: 1031 - RNA, 403 nt, Artificial sequence
  synthetic construct
gaaacguuagccaauaaacugcuaggaacauuugcauccggaaaagguguagucgagcuaugguguuucuucuuugcaaauucuuguucaguuuauuauaaacugcuuuccagaguaccauuguuggguccuuguuaugcaacucccaugccaauguccaaguagcuccacccggguauccuguaugaugaaaauauacucuuuucuuccauucauccccagguaaagcaaugucugcaguauuuauaacuauaacauggucuccacaaucguucauuggaugauaaauagguuuaugagcucccaucaaauaaauuuucagauaaucugcagaacugaggggauuuugccaggcugcaucauauauaugccagauccgugcaaauguagcccauuguugaac

SEQ ID NO: 1032 - RNA, 403 nt, Artificial sequence
  synthetic construct
gcaaauucuuguucaguuuauuauaaacugcuuuccagaguaccauuguuggguccuuguuaugcaacucccaugccaauguccaaguagcuccacccggguauccuguaugaugaaaauauacucuuuucuuccauucauccccagguaaagcaaugucugcaguauuuauaacuauaacauggucuccacaaucguucauuggaugauaaauagguuuaugagcucccaucaaauaaauuuucagauaaucugcagaacugaggggauuuugccaggcugcaucauauauaugccagauccgugcaaauguagcccauuguugaacccguuucaaagcggacauaacuguuuuaaguuuuacgggguauuucaaaaagaaauaaaaauugaguaaauauac

SEQ ID NO: 1033 - RNA, 397 nt, Artificial sequence
  synthetic construct
guguauaagagacgguaccaguaccacggggagcugggaugagacguacaguuacagacccgcauuuuccggugacuuugcaaggcacugugugggguugaccgauuuuguuaccccaguaaccucuacgaacugguacgacggaaagcuuggcuaagaugauggcuccacggauagcaguagcaacuucuuugcugcacuucacucccaaaccaauguggccuuugcuaucaccaauagcuacgaaagccuugaaacgaguacguugaccagcacgagucuguuucugaacaggcaugaucuucaauaccucaucauucaguucugacccaaugaagaaaucgaugauuucauacuccuugauuggcagggaaaacagguagaucuccuccaaagc

SEQ ID NO: 1034 - RNA, 243 nt, Artificial sequence
  synthetic construct
ggauaaacccguuguacuugcaagaguaaugaaaguucuggggagaacugggucccagggccaguguacccaagucaaaguagaguuuaucggagagcagaaucgucaaauaaucaggaauguaaaagggccagugagagaaggugauauccucaccuugcuugaaucugagcgcgaagccaggagauugcgauaauguuuuauugaggugguguggugaaagaaguuggucgaauuucaugc

SEQ ID NO: 1035 - RNA, 294 nt, Artificial sequence
  synthetic construct
gggugcuuucucuggcuugcuuuucuuugaggguuuugguuuaucaccucccuuagccauuuucuucuuaccauauaaaguaccguuccuugaugcaguuuuccucagcacaaggaaaguagcgguacgaaugugauuucuucgagaacgugcccugcgcaacuugaagcgaucaaagucagugagaaccaaacgcuuuucuuuagcggcaaccuuuuucgcccaaacagacucgucccacuuuucguuuauuuuagaaucguuccaugcuuuacggacaacccuugucgaugc

SEQ ID NO: 1036 - RNA, 327 nt, Artificial sequence
  synthetic construct
ggccuccuucuggucaccgguccuuucacgaucaacgcuugccccuugagacgcaucagucagcguuauguuaucgcuacucaaacuaaaguagaugugagcaaaguugagauuccagcuaaaaucaaugaugaauauuucgcuagaaagagggaaaagagggcuaagaaggaagaaggugauaucuuccaaaccaaaaagaggguuacaaagugagugacgagaggaaacaggaccaagagcaauuagacaaacaaaucuuggaggccauccggggacaccccgacaggaaagugcugaaggccuacuugucugccauguggggcc

SEQ ID NO: 1037 - RNA, 437 nt, Artificial sequence
  synthetic construct
guacuacuuauguuugaaauauuuuccucugcaucuccagaaacgagucucugcuccgcuuccaagagggggcaaucacccaaaguuugauuaauuugcuugauuaccaucucuauaucacuaacagagguagcauauucucccaauauccaaagggcugcacggugaaccuuuacagauuugauauccuugaaaguuuccaauaauuucucuauaacuagaggcugcaaauucucaaacuucuguacggccucucucacaaacacaaguacgucaguggcugccaauucauuacugucggacaaaaacuccaucaacacuggaauuacgguaacggccacaucuggaaauuugauacagcaggaaugcaacgugcgaacuaauaacugacgguacuuuccugugucuucguguucacugucaagcguuuuagagac

SEQ ID NO: 1038 - RNA, 428 nt, Artificial sequence
  synthetic construct
gcuaguguggcaauggaccuauuagaaucaguuaugagauucuccaaauccaaauugcaagcaguuacugcagcaggaugugaaaucgcaaccugauugagcguucggacugcugcaaaucucagugucgguuugggggaaccacagaagaguugaagaacacuuauagcuggagccaauucccugcuuguggugcguuucaaguugacaauagcgugugcugcuucguacacuaccauuucugauuugugccucaggcaggauucaaugaauucaaaguaaggggaaucuucuuccuccagaaguuuugcgguuauucgaaucaacauacaaacagcauaaggggaucggagagacauuuuugucaauuuugcaauuagcuuaguaacugcuaaucggucaguuuuccuuauaugauauaguagacc

SEQ ID NO: 1039 - RNA, 427 nt, Artificial sequence
  synthetic construct
guucaagucuaauauaaucgguauaugaagugauuaaaucguccaucuuguaaccuugagagguuucgcauaaaaguuucguuuuucucauuauguuuccuaugguuagaugaaaguagguaaccccugaugaccaauuacucagcucagaguacucauggauggccaaaauaucuuuggucugcggauguauaauauugacuccguguuuguugauggcuaucaggauaaccucaggauaaguugguucgguggacuguuucaccucaaagaacguagauccgaacgugggccauuugaaaguggucuucaaaaauugugucuucgauugcucuccguugauucucaaauuccuguauuccgccaaaauaguuuuccuccacuccgaagaacuggcagcuuuuacgauaucacagggaaugcaauc

SEQ ID NO: 1040 - RNA, 436 nt, Artificial sequence
  synthetic construct
guucuuccgccuuuaagauagguauaugacucggcgucucccaaaucuaaucguuucuuuucuucuuugcucauaccagccagcaugcuauaaaaaauaugauaguuacgaucaccgucacuuuggaaaacaagucuacuuuucuccaaaagguacugaucgauaugggcgcccucuauguuucccgcuuuguugaaucggauaucgauauacuuuccgaaccgggaagaauugucguuucugacgguuuuagcguuaccgaaugcuucuaagaugggauucgcuuccaaaauuuguugcucuauccaaguaugcugagcgcucguugaagcgagguacugaagaauaaguuucguacuuucuguuuuuccugccccacucucuccacugaugacuauacauugauccuuuuuaguggucaucauguucguguagc

SEQ ID NO: 1041 - RNA, 429 nt, Artificial sequence
  synthetic construct
guauucuuguuuggagauccacaucugcuggaaaguggaaagugaagcaaggauggauccuccaauccauacggaguauuuccuuucugguggggcaaugaucuugauuuucauugugcuuggagccaaagcaguaauuucuuucugcauccugucggcaauuccuggguacauggugguaccuccagacaauacuguguuggcguacaaguccuuacggauguccacgucacacuucaugauugaguuguaagugguuucauggauaccauuugcuuccauacccaagaacgaugguuggaagagagcuucugggcaacggaaccuuucguuaccaauggugaugacuuguccaucgggaaguucauagcucuucucaagggagcuggaacuugcggcuguagccauuuccuguucaaaaucaagagc

SEQ ID NO: 1042 - RNA, 318 nt, Artificial sequence
  synthetic construct
gacggacgacaagaaagcagaagacaagaaaccaagcagcuccacuucugaggacaaaaaagaaaagaaggaugaaaaagacgagaagaagaaggagccugaaccaaguuucgaaauucugcaaaauccugcgaggguaaugaggcagcaacugaagguucuuucgauaaaugauaguagccaguacgcacccgcgaaggaaguauccaucgguggcauaaucaugguucgcaaucucaagccuggagaugaagaacuuguugagcccguugcagcuuucggaccgaaaggugaggacgagaaagaaccugaaccacc

SEQ ID NO: 1043 - RNA, 431 nt, Artificial sequence
  synthetic construct
guauuuuuucguguuggcucucuugggcauacgccaccauaucgaagaugguaagauuauuccuggagcccaacauaaccauacccauagcuauaccagcagccuccccuguauuagcaucauccugauaaagguugaacuuuagcuggucauaaacaucaguucugugagugcccaucgcagcuagaccuaggccaaggcagccgccauguuucaccaucucauuuugcgaauccuucaccugacccagcagguaaucaauaauguucccaccaugauuagcguggauaaguccuagagcauacaaaccaccaccuuccgaauaccccgaacuagguccuacuucuuugggaagauaacuuugcauuaagguuaacgcuuccugcucguguccccuguguauuacacccaaagaugcuguugcuguuaac

SEQ ID NO: 1044 - RNA, 404 nt, Artificial sequence
  synthetic construct
guugcuaucauuuucagaaucugauucucuuuuacuuuuuguauuuucuuccucauuuacggacucaaaauccuuuuuuuguucugacacaacauuugucucauuuucugaaucauucacaugacugcuacugauuuuuuuccauuuguuugacagacccagcaauuuuucccuuacucuaucgcugcuaucgacuuuagcagcagaacuugcauucagagcuccaggucuacuuguuucuuccucagccugugccucugacucuugagcugacuuuguuuuccaauuuuuaaccaaugccacgaauuuuaaaccaggucuguuagccucaucuucaggaaaaauguaaucaaaaauuucuucccaucccuguucaaugccaucuucaucaauaauuuuuuguc

SEQ ID NO: 1045 - RNA, 452 nt, Artificial sequence
  synthetic construct
guacauuuuccaacauuuccuccauauaaguguauuuguaccaaaaaguaucaauccuagguaauaucguaacagcucgaucccacaaauuucuugcaugguuuaccugccgauuucucauuuccauuucuguauauuuuaaccauauugggacucucuggugauccacgucuaaagcucucucccaaacugaucuugcacguuguaugucuuucugagauuccucccaucgugcauauuucauccaguuagauauguugguucuauuuuuucuuauguugucuucgaacuguuuccgucuucgcaacugauaaucugcaagcucagcaggaucagaaauuuucugcuuuggugggggugggagaauuuccaaaucucucucuuuagcuucucuuaacaauuguucagcagugauuugaauuucugcaggggcuuuauuuuugaccuucgcc

SEQ ID NO: 1046 - RNA, 196 nt, Artificial sequence
  synthetic construct
gguuccaguuauguuuaugguuauguagaugcsuaauuucaaacccaagaugucaaaggaggaaugugcgaaauuugucacaaauacucuggcucuugcaaugucuagagauggaucaucuggagguguuauccgucuagguauaauuacggaggcgggaauugaacgucgugucaucuuaggcgaugaucuaccc

SEQ ID NO: 1047 - RNA, 441 nt, Artificial sequence
  synthetic construct
gcaucuuugauaauuauuuucauccacguauuguucuaguagaucaagucuuucaauuuccaucaguaaaucacaugcuucugcuucagcauugugagccauguuauaaggaaggaucugcuuagccaguaaaauuaauuuaucucuuauuucuguguucaccaugaaaucaguuucugcccauucuccagcaaucucuccugccaagugacgaacauauucguggccccacucuccgauauuacccaaauuagagagaagucuauauuugagacauucccuuccuucucccaucgucauggccaauacagaaauaauaucagcaaaaacauuuuuuauuucuggguuagugacuuucucauaagcuugcuucauaguuucauaaugugguuucaugaauuugagagguuuaggaacggacgucauagaugugguagaugc

SEQ ID NO: 1048 - RNA, 445 nt, Artificial sequence
  synthetic construct
gauuuuaaaucugcccaucuuuuuguugcagccucaucuucagaaaaaacagguguggauuucagcuguuuuucguacaccucacauaaaccagaccauuuuaucaguuccggaguagugaacaauuucaaaaguagcuuguauaauggaaucucuuccaaaauuuuaucugccaacacccuaugagucaagucaacuuguucacugucgugaguagcaaggaugagguauaaaacaacugcuugcgcagcacuuugucuuucuuccggaacagccaugaugcuggggguguucaaaacagcccuguaauguuugcagguagccaaauaagauccuucguguugaucaacugccaucaucaggcgauaauauuuaagcuucagaucggaggcagcuucaucuucaaagaacuuaguauugaucuuuuucgauaugauuuguguac

SEQ ID NO: 1049 - RNA, 429 nt, Artificial sequence
  synthetic construct
gucccaguuucuuggcaauaucuugaggagaaauucucgaguaagauaauccgauggaucuuauugccguuuuaaugacauugugacguaaacguaaaaucagcgugaauguauggucuugccugaacugcgguccaaaauucuccaacaccucgccgaaucguuguaaauuucccauacggacagcuugagucaacugaaaauauggagccaaagaaugccucauacuggacugucugaauaucugccuuuccgguauaucucccagaaggagcucaacuacgacggugaguuuuugcacuguuuggcggaauccaauagcagcguucugaggcgcuuuccucauagcuuguacaagauguuucugagcaacacuauacucuaaccgagccgcuuugauacgaccuaaauaguauaaaaaucuugccc

SEQ ID NO: 1050 - RNA, 438 nt, Artificial sequence
  synthetic construct
gucauuguuuuuuauauagaaggaugaguugaaaguggcuugguuaauaucgggaagcaaauugaagauauccugcagcugguaaaugauuugaugguuaauugguaguuuguucucggagacuuguaucaaguagucucggauuucccgcaguugcaggugcagaccuuucaaaccuaagaguugauugguuauucguugagacaacgugccaacugugguaucuuugauaucccucagaaggugcuccacucccaccuccucugcuucuuccgccccuauuucgcuagguacaugcucaaauguuuuggaagugggcgauccaucaucguggacuuccuccacagcuugauaugccucgguugggaggccuagauccuucgguuuggcaucaauuauuaccaacacagaauugggacaguaucuccuaauuaguuc

SEQ ID NO: 1051 - RNA, 435 nt, Artificial sequence
  synthetic construct
gauucuccaauguauuuaucaacaauugcacuggaaacaacuuucaagaaauuugcaucuaauugagaggcuacagcccuagcaagaagaguuuuuccaguuccuggggguccauauaaaaggcaacccuuuggaggugugauuccaacccucauaaauaguucaggauucagcagaggcaguucaauaaccucucuuaauucccgaauuuguucagagagaccuccaauagcagaauaagugacgucuccuggaucuucauggcucauguuauaaaccaagggguccacuucucggggcagauagcgcauaauaguuaauguugucauaucuaaagcuacucuugucccugcuuucaauuuagcuuuaucuaauugucuucgacagccaacaacguagcggggaccguuaguagcuuuaacaauaaauuuuucc

SEQ ID NO: 1052 - RNA, 433 nt, Artificial sequence
  synthetic construct
guuccauccucucccuggauaauuggagacgaaaucaaagcaucagacagaugagguccagggggaacuguuaccagauggcugcuaguaccguccuucccauucaaaguauucacaaaauuaguaaggaucucggaguuuaaagcgucuuccccaaagcuaauaagaucaacguugacuuuuucuuuuuugagcuucuuggcuaguuugacuaacucuuuuucuucauuuucuacaggacuaccaacaaaaacaacuaugcgcauuuuaugguuuuugccuugacgauguuugagagcaagaugagcaauucuaaucccagugugcagauuuauuucaccaucaggcuggauuugauguaauuucgauagaauucgcccaacaucacuagucaaaguagcuaauaccucaaccuuugccaaaguuaacaacc

SEQ ID NO: 1053 - RNA, 429 nt, Artificial sequence
  synthetic construct
gucuaaaauaucgauucuauucguagccauaaugacuuugauguuuuugguagcuucaaaaccgucuaguugauuaaggaguuccaacaugguccucugcacuucagaaucaccaccagaaccugauucaauucgagaugauccaauagaaucaauuucauccaugaauaugauagaaggagcauguucccuggccauaacgaauaguucacgcaccaugcgagaaccuucuccaaugaauuuuugaacuaacucggaaccagauacacgaauaaaaguacauuccguauggugagcaacagcucuagcaagaagaguuuucccaguuccuggugguccauaaagaagcaccccuuugggcugugcuauaccaagggcaucgaauaguucaggauguuucacagguaauucgauaaccucuuugauuuc

SEQ ID NO: 1054 - RNA, 431 nt, Artificial sequence
  synthetic construct
gcacuuuaauuucuucugauaaagauucuaaaucuauacaaccaagauaucuuagggcaguucuauaguacugagcguggucaccuugaauucuauaauauugagaagcaagaagauaaaaccuuccaugaacggcaguaaucccaucugcauuaucaaguguagcuuccacuucuucuauaaucuuuuuuguggcaucuaaaucauuuaguuuuucaagaugaauuugaccugcuaaaacuuuacauaaauuuugggcaucaggguugauuuuaacuuucggcucagucuucuccagaaauguaacugcuucuuuagggucuuuguacugcuccacuaccagggcuacuauuucuaccaaagauaaaggguuuauuuuguuuucgaagguuuguaugaaauugugauaaaguugaauuaaguugucuccc

SEQ ID NO: 1055 - RNA, 204 nt, Artificial sequence
  synthetic construct
gauggagguuuggccuuuuguuucucgaguugugcucucaguuguuuauugaaaucaucuucaacauugucguccucccaguuaucuucccauacacuaaugucuugaucguccuuuuccuucccuguccagucuucuacaggaaauucuucaaauucaucaucuuccuccaggacgccaagaucuaauuuugguuuuucugac

SEQ ID NO: 1056 - RNA, 442 nt, Artificial sequence
  synthetic construct
gcuccauuucuuuugauuucgugccuccuuacuuuuugccucugauuucuucgagaacucuucaacuggcgacauaacaggacuguuauacgacgauucuccuguuccauuccaguucugacuugcgcuuuuaggacuugaggccuuugaacccuguuggcugcuacaacuccagucgucucgaacauagcuguuuccuccacuguauaaggaagacuucucaccaggagaauaguugucuccccccacuugagaauaugcgccuggguugucgcuacugagcgagcugacuucucgccaaccuuucuugcucaacucaccuaccuuuucuccuacuugagauccaauuucaacaaccuuuuggcuggcgaauccaccauacuucacugcauuuucaguugcuuuacuugcuauuuugguggcugacgaugaaaggaaagac

SEQ ID NO: 1057 - RNA, 429 nt, Artificial sequence
  synthetic construct
gcuagcucuuccuuauuuggcacauuaucagcugauuucacuuuugaagaucuauuauaauuauauauauuuucucuagauccacugucauuuaagcuuauuucauuauuuaauauuuuuuguuugcuuuucucuuugcaucgcuuuucgauuccuucaauagugauaagaagugcauccaaugacaacaacuguguuugauucaauccauuugucgcagaaaacguaaauuuggcuaacaacuuuguaaauucuucaaauagauugaggcaauauaggucacaaucauaauuuaaauauaacucaguauggaaaccagguauucuccacaacuggagcagguuuuccauagcaauuucccuauguucguggguuaucuuaguugaaucgcucgauaaaauguccaucaauuuuuuuaaauagaauucc

SEQ ID NO: 1058 - RNA, 437 nt, Artificial sequence
  synthetic construct
guacccuuuauauuauagaaaugaaccgaacuauuguaaguaaugaauccaacuuucauauugcuuuuuucuuguccuugauccacagguagauucugaaugauguuuuucaucugggaacauaaaagguucaccaugccagauuugauauuguuguaagaaacaucuauaagaaaaauaauggcuggcggauuuggcaaaguauuauuccuacaauaaucugcuguugcaacgaauucguagguaccgaggaccaauucgggccuuucauagcgauccauucguugaccaguaugguccagauguugaaaguacuccguuggaacaucaguuguagccauacagaaaagacacugaaaucuucuuccugaaucaaugaauugcauaaaugggcacauguaggcuuugcaccguauacaccuaacaggcccuaauuc

SEQ ID NO: 1059 - RNA, 434 nt, Artificial sequence
  synthetic construct
gaaaaacacaacucuacaacuauuauugucccuaaucacuugcaacguagcugaguaaggcuuaucgucauucagauaauuaacaaauuggugcagucuuugauuccgaagguuaucuaaaauuggcaauucguacaugucgucagggauacuguuauaauuacugacuccuagcgcuuccgauaaaaacuccugcgaaacguucggacacacuaaaaucaccauaugcucgccuguguccaugaggaaggcccccuuguucucaagacaccuagcagucaguugcagucugggcggcaucgaaacggguuccucuucugaguucaaaaucacuuccugauucuccaaaucguguaucggguacaaguccggguauauauucugaaucaacaaguacagagguuucgucuucauguuaaucauggacaugaccc

SEQ ID NO: 1060 - RNA, 432 nt, Artificial sequence
  synthetic construct
gauuauuggugacugguccucuucugaugcaagacaaaguuguguagcaacgucaggaugccaagcaacaacuuuccaucugauucgugaaaccguaucagugaguuugauaauugguucauuuuuucuuagaucccagauaacacauuuugauggauauguggaagccaagaugugcugaacuuguuuauuccaugacacugauaggacaucuucgugaggcugacuuuuugcuccuggcgacaugggaguacuaguauuauucaaaucccaaauaaaaauuuccgaaucuccagcuccuguagcaaacaaauucuuuugaaaauuauugaaauccauugcauggacuggccccguauguuuuucuugcuuuccaacaauggcaucuucacccuucaauaauuuugaagcacuauauauuugaauuaaucc

SEQ ID NO: 1061 - RNA, 427 nt, Artificial sequence
  synthetic construct
gagcucgaggggacguccuggcaaaucggaccuugccaccuuucccuuuccaguuguuuggccauacaaggcauaguaauuucuuaguucgucuuccgaagcugcuugaggcaaaucaauuuuguuaccuaauauaagaaccggacaauucgaaagagucucgucugugaguagcgaauccaauucuuguuuacucucuuugaaucuguuccuaucauuggcaucuacuaaaaagacaauggcgucaacagcagggaaguaguccuuccacacucgccuugcuugugaauggccucccaaaucaaaagucgugaaccucaugcugccgauugacaauucuucugauguaggauguaaagugggaagaugcugugccagccuaucaucuuugagcauaugcaguaaaguuguuuuuccagcauugucc

SEQ ID NO: 1062 - RNA, 434 nt, Artificial sequence
  synthetic construct
guacuucuaauuuugauucuucuacccaccuaucaccaucuucuuuccaaauuuuuauuagguuaucacaaccuccagaaaccagccucuugacagguugcgauuguugaucggucucagcauuuccaaauauuggcguuauugccggugaccaacuaacagcauugcauccaauugcaugagcauucugaaucuuuuuugcaucccaauuauuacuaccagcauuguaaguuaaaauggauauggacccaucacugcugccacaugcaagaaugagcccuaauucugcaggggcgaauugaacagaguugacacuagaaucaugauuugcauauucauaguauuuugaccacuuccucuguuguucuuuccauauuaucacuuuucuaucauaggaacaagaugcuaggagauugccguauuuuggauggcuc

SEQ ID NO: 1063 - RNA, 429 nt, Artificial sequence
  synthetic construct
gcuaugcguuuauagaaaucguucaccggauugagguguacaacuuccguaguagcucucugcgaaggaucuuuccuagcaguuagcgcucccggacccacauugggaagcgaugcuugaaaaacggugacacgacccccaguagagcucaucaacuugaaggccacuugcaaggcugcaccuaaagcagaguuagugucguaaguauuagaaaaucgagaagguaguagccucaaaaggucugcuaucaaauccauucugucuuucagguugaucaacaaguugucuggagugggaaugaagggaucuucaauaucuagaacagucauuucuugugguugaguuaucccuucuggcagggaguagaaauguagggcggaaucauaagcaauaaaucccaggugaguucuugcauccccagguaaguuc

SEQ ID NO: 1064 - RNA, 432 nt, Artificial sequence
  synthetic construct
gcaucuccagaaacgagucucugcuccgcuuccaagagggggcaaucacccaaaguuugauuaauuugcuugauuaccaucucuauaucacuaacagagguagcauauucucccaauauccaaagggcugcacggugaaccuuuacagauuugauauccuugaaaguuuccaauaauuucucuauaacuagaggcugcaaauucucaaacuucuguacggccucucucacaaacacaaguacgucaguggcugccaauucauuacugucggacaaaaacuccaucaacacuggaauuacgguaacggccacaucuggaaauuugauacagcaggaaugcaacgugcgaacuaauaacugacgguacuuuccugugucuucguguucacugucaagcguuuuagagaccucuuucuuuaaaaucaguaccauc

SEQ ID NO: 1065 - RNA, 441 nt, Artificial sequence
  synthetic construct
gcaaucuuucacaacgaacuugaggacugccccgaaagugccaacgcaagcagcuaggucaucgucggggaacuucaacacuacauaagugguaccagacucguuauaagggagcuuggggcaaggaacuuccgaaauaaucucgaacaucucgcucggcuccaacuccacccugacauucuccaguagcugaucacuuaggguguucaaacaaucaaauugcagaacaacguggugagugaagcagugcuugauacaucggacgaaguauucuguuucugauucggucaguuccacgacuucugagcugcggaacaaggggcccaauugcuguauuccugguauagcgcugaguuuuucgguaaaguuuucuucucgcgagacuggaacuggucuugcggggcccugagacacaagcauacccucagcucuguguuugac

SEQ ID NO: 1066 - RNA, 439 nt, Artificial sequence
  synthetic construct
gcauccauaauauuaucacucucgcuucccaaagacauuaccuugucauacaaaguuacgaauagagaaaauccgaagacauccuuuagauuaagagugguacuuauuugugcgagaaguucuucugaaguuguagccgaaucaaccuccacuauuugacugguaccguccaugagagugacuucgaggugcauaggagccuuauucuugguggccaugaguuccaaccagcuugggggcuguguucuaaccccguuuuggugcguucgauucaaccucccuucacaguauggagcauauccuggaggaccagaucuuauaaaggaucucagauaguuuaugaacuuuuccgauggagaaaagcagcccacacaaagugagaggaguauccaaccucucgcguaugaagauuugauauaguuauuggugaguuguuugc

SEQ ID NO: 1067 - RNA, 423 nt, Artificial sequence
  synthetic construct
guguagcuauugucuccaauugcaaaaauauggggaggcuuuuccuccuuuuuuuuguuuuuguacucuuugacgagaaaguugguguauauuggcagaauuucauaaggauuuaucgcuacuaacauagaaccuguauauguguauaucaguuuuucguuguaucucuuauguaaauuccugaggauagcguauucuuccaguucucccaaauugaucauaucuucaaccccuuugauagaagagauaugcauuuuuuugagaauuugccgguucgaaauauacgacugucuauuaucaucgucuugaauuuugauucuggucgauucaauagcaacuauuuuuccuccaauuggaauguugaauucacuuuccauuagggguuucgcccagauguaaucacccaauauuggauuuugugcc

SEQ ID NO: 1068 - RNA, 422 nt, Artificial sequence
  synthetic construct
gauccuccaauccauacggaguauuuccuuucugguggggcaaugaucuugauuuucauugugcuuggagccaaagcaguaauuucuuucugcauccugucggcaauuccuggguacauggugguaccuccagacaauacuguguuggcguacaaguccuuacggauguccacgucacacuucaugauugaguuguaagugguuucauggauaccauuugcuuccauacccaagaacgaugguuggaagagagcuucugggcaacggaaccuuucguuaccaauggugaugacuuguccaucgggaaguucauagcucuucucaagggagcuggaacuugcggcuguagccauuuccuguucaaaaucaagagcuacauagcagagcuuuucuuugaugucucggacgauuucucuuucagc

SEQ ID NO: 1069 - RNA, 441 nt, Artificial sequence
  synthetic construct
guuucaaaaucaauaaaucagcaugauuggaucugaugaggaacugaaggugaaguucaauggaaacuuguccagagagaaugcuguggaguuuuucaagucgcaacugguguucuuucucacugucacucaagucauccauugucaguucugguuuuucuucuacuuuaggugcuuccucagcagcuucagccccauccgcauuagcagucguagcagucugacucuugaccaccuugggcuugauuuucucuucuagcaacgauggaaucggugcaguguuccuaacagagaagagcaccugcgacaaaaauugcuggguagccgacucguacagaucaaaagcaaucugauaggccaucaguuggcuguccucaucucccaagacaaguuuguccaggauuguuccaacgguggggggaucuucaagaaauaugagac

SEQ ID NO: 1070 - RNA, 454 nt, Artificial sequence
  synthetic construct
gucuccuucaccuucuacuaaccuaauauaaucaaaccaagcaucguaauuaguuggauuuugcaaaauuuccuguucguacugaaauuuucgcuucgauucaaucaccucaucuaugucacuuuugucuccauauuuuuuuucauguauuguguaugacuuauagaguucuuuagucuggucuuuggguaugugaucaagcgcauauuuguagauuacccuugcucuuucaugcucuuucugauuuucuucgaauuuagcaaaagcaauguacaaauuuucguccaaaugaucgucaccaaaaaaauuaacagcacguucaaagauuuugcgagcagaaugaaugaaaccauguuuuuccucaaauuuugcauacuuaauccaguguuuaacuucugggugagucauaacaaaccuuucauauauuugucuggcucuaucaauuucuuuauac

SEQ ID NO: 1071 - RNA, 440 nt, Artificial sequence
  synthetic construct
gccauaauuucuauaauaucuucauauucuggaguacucucgggaauuucuauguaaaucuguugucuacccaacaugaaggccaacugcuucuggauagccguaucuggacaaguugugaauauuucuucuaucagagaaugaucauucaacugcauagcuaaacguaaugcuugcgaauacuguuugaauuugcggaacagcaauagagcagucugaagaagcguauuauuuucuggaucggccacauaugguaugcaacuugugagauacaaacagcaucuuugauaauuauuuucauccacguauuguucuaguagaucaagucuuucaauuuccaucaguaaaucacaugcuucugcuucagcauugugagccauguuauaaggaaggaucugcuuagccaguaaaauuaauuuaucucuuauuucuguguucac

SEQ ID NO: 1072 - RNA, 431 nt, Artificial sequence
  synthetic construct
guauugaucuuuuucgauaugauuuguguacgaauauaguccugcuuggcaagacauagucucauuuguucuagaaucagcucuacuuuuucacguuuuuccauagagccauaaguuucaacuuguaguuccuguauaauauucgcagccucuucaauauuacccucuucuucgcgaauuuuagcuaacuuaugaguuaggcgagcccgcucaacuucaacguauaucuuuccuucuguaacuugccuuaacguaucaaugaguuugaccuuaguuucuuugucaggugucucaucaacauaagugcagcauuccuggaccauuuuugcuaccgccuguuucaacugcgaccuucuuuuugucaaaagcacuauguguucauuaagagcagcccaguuuuuugcuucuuuacaaauuugacacacugcaac

SEQ ID NO: 1073 - RNA, 434 nt, Artificial sequence
  synthetic construct
gcuucuauaacuccaucucuaauugcuuucgcaacaaugaauucagcaucuuccgcugaaucaagucccaguuucuuggcaauaucuugaggagaaauucucgaguaagauaauccgauggaucuuauugccguuuuaaugacauugugacguaaacguaaaaucagcgugaauguauggucuugccugaacugcgguccaaaauucuccaacaccucgccgaaucguuguaaauuucccauacggacagcuugagucaacugaaaauauggagccaaagaaugccucauacuggacugucugaauaucugccuuuccgguauaucucccagaaggagcucaacuacgacggugaguuuuugcacuguuuggcggaauccaauagcagcguucugaggcgcuuuccucauagcuuguacaagauguuucugagc

SEQ ID NO: 1074 - RNA, 415 nt, Artificial sequence
  synthetic construct
gucauccuucuucccaucuuuaucuuuuuccuucucuuucuccuuauuuucuuuaucuuuuuucgccucuucuuucuuucccuccucugcaucuuuauugguaaguuuguuguugaucaaauugugcaaagccacgauagaccuaaccaaagcagcaagauagacaaccaacauuuggucauuguuuuuuauauagaaggaugaguugaaaguggcuugguuaauaucgggaagcaaauugaagauauccugcagcugguaaaugauuugaugguuaauugguaguuuguucucggagacuuguaucaaguagucucggauuucccgcaguugcaggugcagaccuuucaaaccuaagaguugauugguuauucguugagacaacgugccaacugugguaucuuugauaucccuc

SEQ ID NO: 1075 - RNA, 437 nt, Artificial sequence
  synthetic construct
guaauuaaacauuucucuuaucaaucuagcagauucuccaauguauuuaucaacaauugcacuggaaacaacuuucaagaaauuugcaucuaauugagaggcuacagcccuagcaagaagaguuuuuccaguuccuggggguccauauaaaaggcaacccuuuggaggugugauuccaacccucauaaauaguucaggauucagcagaggcaguucaauaaccucucuuaauucccgaauuuguucagagagaccuccaauagcagaauaagugacgucuccuggaucuucauggcucauguuauaaaccaagggguccacuucucggggcagauagcgcauaauaguuaauguugucauaucuaaagcuacucuugucccugcuuucaauuuagcuuuaucuaauugucuucgacagccaacaacguagcggggac

SEQ ID NO: 1076 - RNA, 423 nt, Artificial sequence
  synthetic construct
gccgacagcuugacguaccgccucugauugagggucaacaccuggcaaauuuucuaggacacucugcaaaaaggcuggaucauucauuacuucagaauaaucuucaucugcuucaacuuccauagguucuucuuuagcuggaggagcacuaguugacgacucuugggcaucuugcauggacaucugcauggcaaaugcgaucugcucaucuucagucauguuagcaaaaucaacugcugcgcuguuaguuguacuuuguucuucgccuuguuccauugacauggcuaaagcccucucuaauagggcuucuucggugggcuccucuuugauugccuccguuuuaguaccaguuucuguuccagcaacaucuuuagcucuacgagccucgucuucuugccuuuggcguugcucuuccauggagac

SEQ ID NO: 1077 - RNA, 431 nt, Artificial sequence
  synthetic construct
guuacauguacucuucucucccucagugcauacauaccugcuucagugcagacucccuuaacuucugcuccacuugccccaggcaucagcucagcaaucuuccucaaguuuauuccucuaguuagauucauuuuucgagaauggaucuucagaauauccaaccuugccuccucauucgguggaggaaacucaauuuuacgaucuauucugccuggccuaaguagugcagggucuaaaauaucgauucuauucguagccauaaugacuuugauguuuuugguagcuucaaaaccgucuaguugauuaaggaguuccaacaugguccucugcacuucagaaucaccaccagaaccugauucaauucgagaugauccaauagaaucaauuucauccaugaauaugauagaaggagcauguucccuggccauaac

SEQ ID NO: 1078 - RNA, 444 nt, Artificial sequence
  synthetic construct
gcuuccacuucuucuauaaucuuuuuuguggcaucuaaaucauuuaguuuuucaagaugaauuugaccugcuaaaacuuuacauaaauuuugggcaucaggguugauuuuaacuuucggcucagucuucuccagaaauguaacugcuucuuuagggucuuuguacugcuccacuaccagggcuacuauuucuaccaaagauaaaggguuuauuuuguuuucgaagguuuguaugaaauugugauaaaguugaauuaaguugucucccuucugcagcucugguuucuuuaugaaggcgaggaguuugagagucaacugaugccauaauuuuuuguugugaaguucuucaaguucugcccauacagaucccaguucuuuagggcuuucuugcuguuuuuuagauaaauacucacugacauuugacuguugcaccgcagcugcagcc

SEQ ID NO: 1079 - RNA, 434 nt, Artificial sequence
  synthetic construct
gcuauuuugguggcugacgaugaaaggaaagaccaaccauuugcuaaagaugacauggcagugucaacaaacucuugggacugacuucuuggagguuguucuuugguauauccgaaaccgcuguacuuaccgccuugacuuggcgggagaucacuucuccgauuagcauucucggacuguuuucucucaaagaaaguuucagucugacuccgaaacucuggugaauuuaaauuuugguaggcaccuugguaacuuucgguacuguuggaauaagaucuagugaaauuugacguggaaugaguaucucuugagcuguucuuuugagaggaagauccuacaaagcuacuauuguaauuuugagcaggagacuucuguucgucccaugacuuuccuugagcuagcgcagauaucuuaucucuguacaaugcagcugc

SEQ ID NO: 1080 - RNA, 442 nt, Artificial sequence
  synthetic construct
guaaaucuacuacauuacuaacagauaggguuguuaaugguguugacgauauggaacuuggaguugaaucuugaacuacuuuugguggaacaaaggacugaauaccuucagaaucaacuuuuucucuuuuucgguaugucuguuuauuuuuucguuuuguucuagucugguccaaaguucccguacgcauuugaaacuguuuuauacugguuguucuuaaauccucacaaaacuguggaagucucauaaaaacuaagugaaccauaucuuucaaauaaugcucagcaguuuuucucaaaaguucacugagucuuguuucaaaacauauccugaagcaugacagcauaauuucacauaaacuuucauuuguuagauuaacccccucgggagauaaagugagaguucucaauaccugaaggauucucauuaaaacuacaccauc

SEQ ID NO: 1081 - RNA, 423 nt, Artificial sequence
  synthetic construct
gcucagcaacguccuaauuucuuugugcauaugacacagaaaaucaacauagcuaggagaaccaucugugccucuaucuucgacaagaaaauguuugaaaacagguuccaauuuuucucguugccuaaccaauguuagucucauacaacgaugccuuucuauucguauuucaucaaugauaguccuaacagcuauggaaaggggauuaucuaguuccgguaauccaacccuaucaaugucaacuuguauggcugauggagccccaaauacuuuuugaauaaauucaggauuuacgccuaagccaaaccaaaggaacaugugaauuccauuuucuaauauauaaacuccuuguucguucaucuucucaauacuacaacgaacaggugguggaauaguaacugguuccuuuguaggaucaauauc

SEQ ID NO: 1082 - RNA, 444 nt, Artificial sequence
  synthetic construct
gacuccuagcgcuuccgauaaaaacuccugcgaaacguucggacacacuaaaaucaccauaugcucgccuguguccaugaggaaggcccccuuguucucaagacaccuagcagucaguugcagucugggcggcaucgaaacggguuccucuucugaguucaaaaucacuuccugauucuccaaaucguguaucggguacaaguccggguauauauucugaaucaacaaguacagagguuucgucuucauguuaaucauggacaugacccuaucaucuacccuaguggcaccucccauccugaaggcgggaugcuucaggagugccgauauguacaagggcagcaacuucaaacaguucggcgccaaaagaccugauacagagcucgccauguugagggauauuuuguaacucguuaauauaucuauugcuacguuuaugaaagc

SEQ ID NO: 1083 - RNA, 430 nt, Artificial sequence
  synthetic construct
gcaauuauugauuauggaacuccaaucuucggaaacgauugcagauaucagggaggagacauagucguuggucuguuccaaguauuugaguuggguucuugccagcaaaucaggaccuccuguugcugauauuauaagagcgucagcaaaacguuuugccugcaaacagaguucgacugcagcuucaacguuauucaucaacagugcuuguguuauaaggccuucagugucgucauuuguuuuuauuuugaauaguucagucuuuuuuguaucuuuuugcagagguguggaacuugaaacaucaguggcugcaaaauuuucuauccuauuuaaauuaucaaaaucauuuguuaauccauccacaauauucugcucaucuuucguuacauacugauucaauuuauuguuaaugucuucgauacuauauccc

SEQ ID NO: 1084 - RNA, 433 nt, Artificial sequence
  synthetic construct
guaauuucuuaguucgucuuccgaagcugcuugaggcaaaucaauuuuguuaccuaauauaagaaccggacaauucgaaagagucucgucugugaguagcgaauccaauucuuguuuacucucuuugaaucuguuccuaucauuggcaucuacuaaaaagacaauggcgucaacagcagggaaguaguccuuccacacucgccuugcuugugaauggccucccaaaucaaaagucgugaaccucaugcugccgauugacaauucuucugauguaggauguaaagugggaagaugcugugccagccuaucaucuuugagcauaugcaguaaaguuguuuuuccagcauuguccagaccuaggaaaagcagcuugccugauuucuuccauaaucccaaguaaccaaguacaccgguaaaccaaucccagaugaac

SEQ ID NO: 1085 - RNA, 433 nt, Artificial sequence
  synthetic construct
gcccuuagcuacaucacuuaugcacugccaaacuccuucaguguuuugaucccacaaggugauuuuauuaucuccaccagacacugccagaauauuuccauucaaagaccaacugacauuccauacaacaucgucaaauguauggagaacaguagaauuccaguugauacaaucauuacugguccagaugacuacucuucgaucuugggagcaacuugcuaugauaaaucuguggaggccuacugagggagcccaagccacaucccuaacccagucggaauguacuucuaauuuugauucuucuacccaccuaucaccaucuucuuuccaaauuuuuauuagguuaucacaaccuccagaaaccagccucuugacagguugcgauuguugaucggucucagcauuuccaaauauuggcguuauugccggugac

SEQ ID NO: 1086 - RNA, 280 nt, Artificial sequence
  synthetic construct
uaccuguggcucucacaggcagcgaagaugguaccguuagaguuuggcauacgaauacacacagauuagagaauuguuugaauuauggguucgagagaguguggaccauuuguugcuugaaggguucgaauaauguuucucugggguaugacgagggcaguauauuagugaaaguuggaagagaagaaccggcaguuaguauggaugccaguggcgguaaaauaauuugggcaaggcacucggaauuacaacaagcuaauuugaaggcgcugccagaagg

SEQ ID NO: 1087 - DNA, 3454 bp, Leptinotarsa decemlineata
  Annotation=Sec3
ctcataaagtgattaagagaaaagtatatggtaggcgtttacttcttatatctaatgattcatttcttaacacaataatgacttccacgatcatacgtgatttgcaacagtatgtgtttgaaccaaacgaagagaggttgatatcatgttgtcaggttagtaaatatctgaagaaaaagaatcttcactactgtgccttgtcaccacgacggtacttccatacaatatcagtttagttcaagtaaaacaaactgacaaacagctattcaagaaaaaacgcacttgggctttagctgaactcaaatccgttgatgggcatacagactcttatgaaacattggaatttgatttatatttggacaaagtttaccgttgggtagcatccagttctaaagaaagacatgcttttattcacaacatttggaagcaatcttcacgtcacatattgaaggataaaccaatgttcaaaaacattccaaaagcatggataacggaagatgccatgactcctgatcacaaatacattacctcaccattgctgacttagataatgattttgctgatgattttcaagcaattactgacaaggaacaggaggacctcaagagattaatgtcatgttgtgaatatgccattagcaatgcagaaggttttatggaagttctagcaagggatttatctcttctagatggagagaatgttcaaagtgtactggcatctgaagaccaggtggaaaaattgatggatcagttagaagaggctataaatgaagccgatagacttgaaacacagctgacatcttatgatgaaattctctgtcacgtcagagatacaatggaaaacatggaattcaaaaactccaccatttctattgccaacaaaaacaatcagtggttgatgagagaactggaaaatgtcgtgaccaaactggatctccccagtgaatatcagagaactctagaggatgctgatttcacaagttctgaaggactaacgatggcgataaaagctgctaatgctctgaaagtggcaatgaactccaatatcgacaaagcattattacagatgtctgccgtccaagaacaaagaaaaaaattcgacaaactgaaagataagttttcacgtagtcttagccgccagttaaataacctctttattcattatgggaaccacaaaggggaatctgacagaaacgttgaaggcctgaatttaccacaacacagcggggttcataaggagctctgtgcttacatggagctcattcattggataaaggttatggataaaaaaatgtatgagtcactgaaggaagtctacacaaattcattgggtaaattgtatgacagagatttgaggggtttattcaatgctgctagagaaaaaattgcagtttatacaaatgtggctccacctactaccttgataggtttggatagagaccagtggactcttgagacatgcgctaaggatagagagagatatgattctgtgctcgaagaagttcttactcaattggagcctgtatttttacaagagcaacaattttgttataaattttttcaacttgatgtgataaatccaactaccaaaaatacccagacgactttggatggaactgaatcaataactgaagttgtatcagtacgtaaagccgagaaacaaatcgatgaagacgttagaaacatgatgagtaacttattttcgtgcttgaaaactgaattggacctattgattgaccatatcaagaaacaggacaatttttactgcatgtacgtgttggttcgcttcaatcagcatgtgatgtctgcccagagttctttccttagcaatacattcgcttcgcagctcatcgaagttaaacgttccttggatcagttcatgcagcaacagattgactccatcaaggaatgtagaatagccaggaagtctaaatgcggaatcctcccttacgtctccaatctggagattttcgcaaagaatgccgattgtttgctcaagagtgatcgacgtgctgatttggagaaatggtacacgagattagtggacaccatgttagaatatattgctgtgcattctatagatcacaagacaccgtcacaggttattaaaatggagaactaccaccatttatactccctgctctcacaactaaaaatatctgtcttggatagccaacgcaaagaagccaaacaaaaatacagcgattctttacaagcttatgtgactttgtactttggaagaccgctggagaaattgaacacgttttttgaaggcgtacaagccagagttgctagtggagtaaaggcatcagaagtgagctaccagctagcgtttagcaaacaagaattgagaaaagttattagccagtacccagggagcacggttaagaaagggcttgaatctctctacaaaaaagtggagaaacacctatcggaagaagaaaatttacttcaagttgtttggagggcaatgcaggaagaattcatcaggcaatataaaatgttggaggacttgattcaacagtgctatccaggttctatggtcacattggaattcactatagaagatattttgcacttcttttcagacattgcccgatcacactaggtttttgttatatgtaatgtatcaagtcagatagtattatggattcggaagcttttacttttcaaactcagttctgcggataatgtattcaccaaaaatatttagaatgatcattgtgatcctgggtattataagtatttattatatgaagttatttataaataatatatatgtttacaattcttacactttataaaataaatgtaatctgggcgttacattaaaatgtgttttctgataagcagttgttaccaccttacaactgtcagctgtcaaaatttgtgcgagctaaggattaacgaagtctaacgttttaacgtgtgattcaagacaatttgaaatatcccacattcaatcatgactttcacgaatttcatctttcaagatctcatgcatacaaaggagaaaaaactaatatttgctcatagggcaaaaatgtaactacatactatttaatgtgctaaaacatttaacaattcatttgtatgaatcaattttggctggttgttctggaatgtcgttgtagaactcccagaaaccagcaacttttccaaatagaattgatcccacaaaaacaccaatgccaagggctaggtgggcattgtatttgcgttgattggcatcataatgtgttttccagttaccctgaggctgaggaagatcgttgtaggagctctgagctggagcatgatggtcgtaacgtacattatttctggtactttgtctagcaagtcgactcactaataacctcggagcctgcattttttcgaataatttgtattaatataactgaaggaatgaatattagcccagttatgcaacaaaatgaaatagtggacctgtctaa

SEQ ID NO: 1088 - DNA, 2915 bp, Leptinotarsa decemlineata
  Annotation=Sec5
gttcatcacagattaactatttgaagttttatcctatggttctaggttaatatgacaaatttgaaaacttaaaaatattaataaatcaatattgagctgaactcgaaaggaaacataaatgtttggctgttatttaaatgaccttatttttctaatacttctcaaaatgtgccaaaagtttacaaaatagaccaattggaaattaaatggcaccgcccccagttgttacaggattgtccccgaacgaagggcctccaggtacaaaaatcaaaataagaggtgaacactttggtacccaaccttccgatctcattggtctaacaatatgtggcatggactgcctcctaactgcagaatggaaatcccaaacaatgataactgctatttcgggacctataaaagttcaaggggacgttattgtgactaccaagtatggtggaactggaacttgcaacgtaatattcaaaggatatcttttaacatcaataggacccatgaaagagagtgcagtttgggtcgaggaaacgccaatgtactcgtggggcagacattctctgagtcctagtagctttcaacaagaagacccattaggattgtcagttgaagaaaatgaaaataaaattaatgaagaacaattaacaagttattttccagggaaatctggagatattggtagcacacaattttctccaatttggtttctgttagaaaaccaccaagcaacaagtttcaatgatctgcaagcaggattggtacatctccgtagaaaagtccagggtcaaaaggagggccagttatcatttcttaaggccaatataggttctgtgatggaacaagttgataccttggttaacctcaaagaaaaatttgaaagagataggtcacaatttggtaatgaaactactctgaagttggaaaagtcaataaaagaatctgaacgtgaagcacggaaattgtttgatgatgtcttggctagaaaagatcgtgctgaaaagacgagaaatgcactaaatgtactatcaagattcaaatttctgttttgtctaccttgtgttattgatagaaacatcaaaaagggggaatatgacatagtaataaatgactatatgagggttaaaaatctattccataaaacagacataccgattttcaaggaagccttaaatgaaatagaaaggcgaatagtggatttacaaaaaaaacttcatgaggatcttcagacaatgcctattaccgttgaacaacaaaaacgtctcattcgttatctaatcaatttagattctccatatgatgcagcttgggatgcaatcaaaagtagatcagaatatataaatgataagttcaaatttatttacaactttcataaatctctggacaaagctgacagcacaaaaaaaacaaattctacttcaaagtactctaaatacaatacctcacaagtggagttgaatgtagttcctgtttgtgttaactttacgatgaaatttgttcaaccctttctgaaatatttcctgatatgtggaaaattggtcaggcatatttttcaggagaattacaagtaaaagtggaagcaggacgtcaggttgaatataaacacatggttttgtcagtcattgaaacattctgcaaacatgttcgagccagtataattccaaacacacttgacaaatctgaacgaactcagtttggtactttgagtattcctgagcgtgatgaagttgccatttatctacctgaactattacgatctgtacgttctacttattcaacattaatcaaactagatctaccaaatgaagctctcgatatagttaattttctcctacttgatctgcggatacattgcatgagcatccttttccagcaaactacagaacaaattaagcagctcacggaagactggagaataaacttcagtggaaagtattcaggtatcactgaattacctttgaagtttttgcagttagttgaagatgttatgcaaattgtgaaagaatctgctttatcaatagagcagagagaaagctctttactggaaaacaactctgctcaaaaagaattagaacggcaagtcaacaacattgtgttatcatttcataatgtattaaacaatgtttcttctgaagatgatgatgagtgtgatgattcatcaccagtggtttcacaactaattggtactcctgtgagctcccataaacttggttcatcaggaccaaaaattccatcatgggaacatagactattgatcactttatctaattgcttattcacaaagaatactattctagatgaaattgcatctaaattcaaagatacaggattttcatctgtagaatttccaatcagaacagctaaagtaaaattccatcaactggaaaagtcaatacttgataagtatttagaacagaaaagtgatcctttggttggtaccattgagccttcaatgtacctaggccgttttgattgggacatcaatatatcaccaacagatatgcggccttatgcaaaagaatgcataaacaacctgattagcgttctgtcagaggtaaataatatatcaggaactcttttagacagtgtcttaccgaggatcgttgaaacaatttctgaagaactatatagactcatgtcatgcgtccaaaaatttagcaaagagggaaaccagcaggccagaattgatgtaggtgcgctgcaggacttttttcaggattatatatccgatgatgccaaaggatactttaaagaagctttggatgccttaccattattagaaaattctgaaatgactattgttgaggatactttgaggcagtgtagagttagaatgaaaacacaggttctgtgtctgaaaaaacaactttgataaagaaatgtagaaatatttttaaatgtatgataaaacactatattagtaa

SEQ ID NO: 1089 - DNA, 1969 bp, Leptinotarsa decemlineata
  Annotation=Sec6
aaaacttttgcacactcatcagtgtttgagagatttggagaattctcgggatgatctgctatttgaattgcacaaactacctaaccagtctgttcatgataaatctatgctgaaagcatattttgctgatgttgaagtcttatctaatctcttggaaaagcaattgacatttattctctctcgaacccttaatactgttaggaaagatccaactgtgattgtaactgcactgagaataatagaaagagaagagaaagccgatgaagatgcagtgaaacagcaaaagcaaactggctttattccaccaggtcgtccaaagaaatggaaagacatggcatttcacattcttgaaaaatctgttgcttcaaaaatagaaggcacccaagtggaagagcgggaagacaataaacactggttaattagatatttagaacttatcaggatgacgcttttagaggatttgagagtagttaaaattctgtgtgttccgtgttttcctccaagctacaaaattatggaaagatatattcagatgtatcatagatgcctatctgtacatttacaagaaataattcagaatggcttgaaaggtaatgaatatgttacaatactttcttgggtaatgaagacatacaaatctaaggatatgttgggtcatccagatttagtagcccacacagaaaatttaccatcattattaccacctctggtaactgacagactagaaggagaatatttgaagaacattgaagccaattacaatgaatggatgcaaaacacattgaaatcagaaaaagaagaatggagatccaacactgaacctcatttggaatcatattcacgtactgctgcacccatcatcatattccagatgatagaccaaaatcttcaggttgcgaaaactatcagtgaagacatgactataaaatccctcaacctgagtatccagcaagtcataggatttgcagaatcttttcgtgatgccattattgagttcaaaaataagtattttgaagacagaaaacaggtagtctattttacgcagtatatgattgttatcgtgaataattgcctgcaactagttgatttaggttcacaattagaaaaacagtatatatccagctcagcatcacatgaattaagtaggaatttcggaatgttgaaaacaacttacattaatttgcgaagtgaggcagtacagtatttactggaggaactacttatcgatttggatcaacactttgacaaactcttcacagctcagtggttccccatgaaccccgctgacaccatttatgccacgatagaagactattttcaagattataaccgcctagttgaagccaactacaagtacgttgtggaacaggtagtgagcatcgtaggaaaacggtacttaaccgccatgctttccaagagaacctctttcaaaacttacgacgagtgtgtgaaagctgctcgcaaagtagtggaggaagctgagcgcttcaaccaattattctctagtttgagtaagaatttagagtgcgaaaattcatttgatgccgttatgatgctggctgaagtactcaaaagtgatgatgatatgctgtcttttgagctccacagagttgtggagaaatatcctgatatttccgaagaccatttgcaaagacttttgagcttgaggggagatctctcaaagtctgatattagagataagatctcgcacatagataaaccgaaagttttgcacaaaagtagcgttttcaaaactcttgtgtttcccaaacttgtaaatatcaatctaaatttttaatatcgagtctgtatattgagtctgtatatttggtatgtaaattttcattatgctgcctataaaagaatgttctgccaaagacaatttcgagggtatttatgtatactattgaaacatgttataatttaacctctcagttgaagtattctcaagtgtatttattatatatta

SEQ ID NO: 1090 - DNA, 4935 bp, Leptinotarsa decemlineata
  Annotation=Sec8
aataatcattagtttatcatatcgtcttgaatagttgagtttcttgcttaaaatgaaagtggaattattattgctgttattaatagtatttttgaatgtttcagcggactcccttcatcatccaattgttacgttatctgaaggagatgttgaaggattcatagaacacacagtgaaagggcgttctttttatgccttcgagggtataccatacgctcgacctccaattggtgatcttcgttttcaggaatcagtccctccagaaccttggaagggtgtgtggcaagcgaaaacaaaattcaagtgtatgcaatatgatcattttactccccctggatctgacatggtctccggagatgaagattgtttatacctcaatgtgtacacccccagtctcaagcattcggaagctttggatgttcttgtttatattcatggaggagcattcatgttcaattatggtgcattatatggccctcagataatcttggatagagatgtggtatatgtgagcattaattatcgtttaggaccgttaggtttcttgagtacagaagatagcgtagtttctggaaataatgggatgaaagaccagattctagccctgaaatgggtaaaatcccatatcaagaattttgggggaaatcctaactccgttactatatcaggaatgtcagccggtggagctagtgtgcaactacattatctatctccaaaatcaaaagaccttttctcaaagggtatatcacaaagtggagtagctctaaacccctgggttttagtagaaaatcctctccaaagatcaaaaaagttatcgtctattgttggatgtccagtagaaaacaacagcgaaatggtaagctgtttgaaaacaaaacctggaagacaaattacgcaggcagtgaaatattttcaaccttggctctacaatccattttcaccattcggtgtagtagtcgacaaaaattgggcaaacgatccatttttagaagaccacccttatattttattgaagaatggatatgttcaagatttgccctggattacctcatacgtgtcttccgaaggtctctatccaggttcagatttctattctgaagaacacatggaatatttgaatcaaaactggaatgaaattattccatacatattacactatgatgatgttgtacccagcaatttgaaagacagtatcactgaaaagatcaaatctgaatatttgcagagtggtaatgttacaaaggattcctttcacatgttggttcagatgctgagtgatcgactatttattgctgatatagaaaaatccggtcgcttacattccgctgcagtgaaatcatcggtttatagttactattttgattaccgtgggtcccatagtaaatcagaatttagaacacataacgatgtaaatttaggaacatcccatggggatgatactagctatatcctcaaaaccaatttggacacattatcaaatgaagatgatcgaatgatgagcaatattatggttgatatgtttacgtctttcatgaaaactggcaaaccaaatatatcttctgaatggatccctctatctaagaaaacatctgacccttggaggcaattacatgtgaccagtccttataaaatatatgcagagaaacaaacggaattgggtaaccaaaaattttggaacaaattaccatttcaagaaaatgaaaagttgttcaatcaaaaagatgagttatagatagaatctgatgaaaataagcaattactctttataatcacataggtagatattaaaataaaagacattttaaaaattaacaagttatatttagttataaattataatttttaataaactgattgaataatattgtcatgttattgattaacttatactgtaacacctacctcaccaagaatatctgataatctttctaaatgaactgataccgaatctgattcatttccggatttacttctgtttagtagctgaaaggcattcatatactccaattctgaaaattcaggtcccttatcaacgagtccattcagaatttcctctggtgttaaaaaaaataattcaaagtaatgtctcgcatggtccagtgctacctctctagtcatggtgatattagttaatgtttgttgaagagcaaatatgtttctacacattcgttgaattcctccttcatttatggcactcatatattgggcagaacttattagaattttggctatcaaatgtcctaatccttcaaatatatacttgcattttcttggatgtaaacttgatgttatagcttcatcaacactagctagtactctgttcaactccagcactttgggatctggttcatgagtttcttttttactttgagtttgggttaacaagtagtgaaaacactgaactcgaacctctaaatgaagaagtagaaggcacgtgtttgctaattcatcaaattcttgggcaacacttgttaactgttgcaaggtagcagcagacactggcggggaagattcattatggctaatatcttgtttcggtggagagaggcctgatggttcagttctaaagtcactagcaaattcaaacattctgatagagaaccattccatgctctcttgtaactgagctaattccctgagtgagttcatatcagaaagaatttctccagctgaaacacccccttctccaagattacttgctaaaatctcagcttctcttctattcctcatccgaacatcctctggactttcttcttcagatggttgacctcttttcaacgttcttttactcctttcactgcgagcatgaaactcctgttgggctttcagattcaaccagttaggcaaagatttcaagaatctgctaatatcatcatctttgagccaagctgcactacatatccatttatcttcagagtgtggttgaactattcctctgtatgcagcattgcaggtatctttatattctttcaaagctttacatgagtattcggctattctctcgctataaagtggtagagaattcaataccactttccactcccttatgcacctttcgacagttactgtactcactagcaggggtttgtagtcagcactgagatctaataatattgtggctttccatgcatctgcagctctagtacatgattcaatttgatcaacaatttcatctgattttcgcttcaaaaagacatttgaaacgtgtttcgtcagaaattgatatatattgctacttccatagttttctatattcattgcttgttccaattcttctatgaaacagaagaagggtataaaaactactagtagattatttggatgtggaggacaaattagaaacttgtctttctttgtagattttagggaatcacttaaactaagggcacttgatgatccttcaaatttaaatagtgtatgtcgtttcgatgtttgttttctccttgaaaaataaactgaaatatcattgatactggtaatattgctgatttgtgaatgacttgaaatattttgaatgtccaagtagtccgtgagaaatgactgtaacaccacttgtacttgagaccagtagatgttgatatcatatgaatcaatttcgatattatgcactttactggccttatctacacacttcaaaaacatatattgatagtcagctgttgcttttaactgatcgaatataatttgtatcaactcctttaaaactagcctttcatccaatccatcaaaatcatttttgacataattagtggttcgttcaatgatttgtgaaatttcaaaatgcatttcttgtattatttcattcatagcaaaaggcaatttttccaaaatacataagctcttcaccagaacggcaataaaattactatgattatcctctggatttgaaacttccaagttttcttcaactggaaaaatccaatgtaccattttttccacttgagacattgaacaaacttcttgagcccgctgaactatttcttccagatctcctcaattctagacttctttgtaaaggagaattaattgtccagccttctcgtccagaaccctgtctacgcaatgctaaaatatgttgggatggtttggtatacaattgctgtttgagttctgagagaagttgcaggtgtagttgctcctttttctgttccaattctaaacttaattcttttaagctttctactccttctagggtttcttttcccaagtgtacggcatccaccaaaagcatagtagcatgtaaatattgtttacgccccatgtgatatgacaaacggtttggaacttggttcattttttcaatttcatccactagttgtagcatatatttgtattccaaaccttctacccataaatttttcagctcatcttttctgcacctcagcttttttttacaatcttgtagatgttccttaactttttttattctttctctgtttgagatgacgatttgagaaatggatccaaataaattcataaccttggaaaggtccttcccatgtttggaaacaagctgatcaactctttgatcacatatcttataatcattctctaattttgctttctctctgtctctttgctcattagtttcgctagctgatagagttcgaattactgacattaatagaccactagtttctttagcagccttcacccctcttggtggcttagaaggaggcgactgatccattttgtggacagaatacaaattttaggatcaccgagttgaaaacatactcccactagtcattgttattcaaaatcactaaaaatttgtggttacagattagatttttcgaaaatgataccgctatatatagacctaatgcgctaaatcctaaaacgtaagtatgtagtatttataattagataatttcattatctttgaaaattgatagaattggtgcataaaaacaaaattgtaaaacataacct

SEQ ID NO: 1091 - DNA, 2311 bp, Leptinotarsa decemlineata
  Annotation=Sec10
ataattacagtaaaataaattaaagcttcagatttatatctaactaagaatgaacactttgggaatgccctatctaaaatttaaatcatttgtttttgtactttaaaatcgcttctgagctgtataaagttgtggagaatcggcctttccaatttagccaaggtgtcttccgagcagacttgctgtagattctccggtttcaccagtagcaggttgcaaagagaatgtaacgtgtcgaatagttccgtaaccagaggtcccagagtcttagttgatgaacggtactcattaagatcgcaaatggccaccatagcacctgcggtattatactgaaactgtagcatatgttcatacaccaccctgtgtaaccgtattcccaactcctgaagaactgccgttacattatttccatctaaactggcctttatctctttgatgattcttttaatgtagttcagaacggttttgcaggctggagacgctactgtgtcaaaatcgtcagtctcaggtttgaagtcgctcttcttctgttccgtctgcaggtacagttttgcccaagtagcaacggcattgagacatctgtccaagcctgtatttattttcctttcaatgtcttccaaaacaaactttttcttctgtatgcagtcattatatttcggtgtattctcgactagaggcacgaccagatccgtgaactgcttctccatcaagtgcgtaatattgttactctgatgaactacgttagaaaaaatacagaactggaggacttttagcgccttcgacaactgggacagcttggagtcctaattctacggcataatctacgtgttcgatcaaaaggctgttgataagtctgtccaaaatctgcgtagcatttgattctttctctttaggttttgataacaactgacaacgttggaaggcttgcttggtatcttggagtatcatgatggcaacttcttctgacaaaaaagtctcgcctccatagttttctatttgcgcaatgtttatattggctctggtacctatgacggcttgtaagtcccttcgcaggtcttggaatcctccagactggatctgttttttctggtggtgtttggattcataatacttttgtaaattggcggaacatctttctttgaggcatttcaattctatcgtaatatattcgtttacgtatttattgaaaatattcgtagtaagcttggtcaaatagtttttgtcgtttcctaaattgaaggtgctcaggttactcgatagctggttagttttcgaatagagttcaaacagagtttgtaggtaattgtaactgccaagattggggcccaatctttggtcgatatactccacgattttcaactggtagatgttaaggacaaacttggccataacctgttcaggattgttgaaaacccttctgattatatcattgttgtatttgcacaaagtcaacagatggccaaacacgtctttggttgaaaggcatcccacttgactttgatcgatgtaagcgtcaatgcactgagaataacccttgaattgtgataagacactggctatttccttcattcgatctagatcttcgttagccattgcgttcacaaattcctcgattaagcttttttcgatatcacaatattttcgttctattttacgtttaacactgtcaaatttggaaggcaaatcttgggatatcatgtacaatttttgaatcatatctgcagcctcatctattaaatagggatcagtgaatattgctgaggatggcggtccagtggttagaaactcattcagatgagtcatcaaacgttgggcatcgacaactctaagcctaggaccattaacgctgtcaagttgatctcccaaatgcaatactttagtggcaacgtggtttattttaccatccagttcttggaaggtgtctatagcttgtttgttttgctccaacaaattataaatttcctggaaaaacattgcctcgtcttctctgacggccatctccaacttttcacatttcttctgctgacgatcttggagaagagtgaggtcttttatggcctgtacgaatgactcgtgtaacaaatttgggttaaactcctcttcctcgccatcattttttgtctcagcaattgttcgccaagctaaacgttccacgaattcttcggcattgaaaggctcctgttctaattctttcatgtactgttgcatcattttgatagttttcagtacgtaagaataaaaattaaaattaaaataaggggcgtaaaatttagaaaactgaggttacgttcattacagatgtcccccgcgt

SEQ ID NO: 1092 - DNA, 2641 bp, Leptinotarsa decemlineata
  Annotation=Sec15
ggggagatattctgtgattcaggttcaggttaggataacaaatggaagtaggagttatttgtgattgaaattggatatgagactttttgctgatcactacttttttcaatatgtttagtacgctttgaaccttcaattataaaaaaatggataagactactttaccagtaattgattctcaatatgatttgtatctacaagaaattgaaggcatagatgattattggggaccgactttcagaacaatatttgataatgatgaacatgtggagttcaggaaaaagctggaagatagaatcaaacatcatgataaagatatagaaagactttgcaatgtttactaccaaggtttcattgaatctgtaaaagagttgctggaagtcagatctcaggctaagaaactgaatagccaagtaataggcttggataaacaggtacaccttgcagctgaaggaataacaaaatctggtacagatttaatacaagctaggaaagtgcagagtaatattgcagaagttattgctcagctaaatttatgtttgcctgtttttactacttattccaaattacagaaacaaatatcagagaaacgatactatccagcactgaaaactctagaagaattagaacatttgcatttgccccatgtagcaaattaccgattctcaaaacagttgcaagtaattataccaaagtatagggaaaaaattgaagttgcatctatgtcggacctgaaagacttcttggaaaatatcagaaaattctctccaaaaataggggaagtagcaatgagacatacacacgagcagctcgccagtgatccaaccgtagttggaagaaaaaagaagagaaatgctccccagccacctgggaatttttctgaagaggaccgtagtgctcaagaactcatagacttttctccaatctacagaggattacatattgcccatgttctcggaagatcttccacatttgaaacctattatagagcagaaagggccaaacaagcaaggcttgttctacagccccctacaaatatgcatgaatctgaggacagttacaggacatatattcaagcagttctgggctttttcattttggaggatcatgtcctgaacactggtagaggactgataactagagtttttttggatgatatgtggaacatggcactctctaaaattgttacaactctacagacccattcggcatattgtactgatgctaccttaatcctcaaaataaaagacttgatcatgctgttctgtaccacattgaggaattatggatattctgttaaaccattatgggagctcgttagagaattgcgtgaccactacacagaagtcttgatgcaaagatgggtgcaagttttcagaaaaattttatccgaagaagattttcaacctatacaggttcatcatcaagatcagttgaacgaaatactcttgtcatttccatgggaaggagacttacctgatgatataacttatccatatagttttcctttttctagtatggtaccaaaagtataccgagaagtcaaagaattcatctatgcctgtgtcaaattttcagaggacctcaatttgagtcaagtggaggtggatgaaatgataagaaaatcaatgaatttacttctcaccagaactttcaatggctgtctctcatccacttttcgaagcccacatgttaatcttcaggaaataattcaaattatagtagatactggttatctggaagaagccaacgtgtatcttgatcagtttatttctaatataactggagaagaatctcggggagtgacatcaggtttgggtcatggtcagacagctttattttcggtatctagagaagaggctgtacgacaaatttgtgaaaaattgaggcaaaaactcgacgagttcttagagctagaaaattatgactggttattggtggaaccgaagggacacgcttccagctacatttctgacactatagcattcctgcaaacaacatttcaaagtttcactaatattccacttgaagcggcacaaattgcttgtaaatcagcttgcgaacacatcgcaaattctttactggccctactactgaatgaagatataaaacagatttctatgggtgccttaaatcaactgaatttggatttgttacaatgtgaacaatttgccgcctctgatcctgtcaaaggtttgcaagaagattctttattatcgtattttgaaacactcagagaaattttggatttgtttatttcatgggactggcctacttacttccacgactatgcacaagaaactaataaatataagaaggttaatccggatgtagctataatactactagaaaagctgaaggaaggtgacaagaaaacgatgtttacagttttgaagaaaagtgaaagagataagaaaaagcttcttgaaactgttttaaagcaattaaggcaattggctcagttgccgacaggaaagtaattttctaccttgttaagaaatatattattgttgtgtaacattatgttcattaataaatatatatattaatactttattgattattctcaactaccgaaaaatattttctagaaaatattggaaaataaactttttttgatcaaagtaaatcgaatgatagt

SEQ ID NO: 1093 - DNA, 2289 bp, Leptinotarsa decemlineata
  Annotation=Exo70
tatacataaataataaaaaagttaacattgtgttttcatatattttttataataaaactgaaatatatctttcatgagtatatacaacatccttaatgttggaaacaatatataaaatgtttaccactaagcagcaacatcaaaaaatctgtcaataattgccgacacttcatctggtttatgtttgatgtacttttctgggttctttgtgaagtgcatacctgcatacctattgaaaaaggcattgtattttggaatgataagctctttgttgtcacgtttgatactttcccgaagttgaatatcaggaatggaatatcctctctgcaccttggaaatttcgtctacttccttattgaatcctccaaatttctcttttcagaattgctctctccttgtctttcagtttgtcaccgtggaagtttgctgatggatcatcgcagctgatgtagttcaaaagtttgttccagctttgagaatatgcctttttattctcctggattgaagtataataatagtcttgacaattgggttcagatatcaagtataaatccatcaaactactcctctgaagtgatttcaagacgtaattattattatttaatctaaacaatgccttaagagcggtgtctccatactgttcgctcttactgatcagtgtatgattcagctggaccaaaacctttttgatataaagacctagtaaagctttactacgatcgctgtatttcaatttactaagctgtctcatataattttgatcttgttctaaaacgataccaattgtgtccgtataatctaataattgttccaggaacatgatgacattgctggtcatctcatgtacggtaccatcacttggtaattgagtaacagaatctgaacgaatgctatcgatgaagtcttctagagctttagatccagtggtgtgtagcatctgtattatttggtcaaatttttgtttcacgttcaagtcataatcttccacagttctctcaaattctggtttcaaattccgcaactgtttgaagattggaaagataaccaaaactgtagcaaagtcatgccttgcaatacactttttagctctggaaattatattctctccgtcctgaacaatggtgtccatcgcttccctaacaatcaattcaaaaactctcggttggtgagctggcgttatgatatctttcataagtatctgttcaaactgcatcaatctatgtagggctatcacagacattaaataattttccatttcttgttcattatctagttcttccccagtgtaagaggtatccaagtgtgaggctcttctcgtaccaagagagagtccagtggaattttccagtgtttgagaagcctttaggaacatcttatttgctttcctttcaaagacttgatgtattcttcttgttgaaggacgtcttgaagcatcatgtcgattaccaaatttaggtttcagcattggagaactagtggttccatgaacactcccaccactaaccgatttttgatgatttctcaacatagtgagagacctctgtaggacacttcctctgactttaccgtaaactgtcaaatattcatctcttccatggtccagcaaccaggatgctatttgaacgaggtgtgactttggttcgtctggaatctgtttgggtataacctttatttctttgttggaaggatcatcgaaattaattagatccaggagaaccactggtaatattggagtattgtacttatccaaaatagttttgaattctgcatttagtttgtcgctgcctttattaaaaaacgatgaaacattgataagttctacactttgtggaatgtttttttcaaaatatttctgggcaccagctaatctattcagggcatccagataagtttgaagatcaatacctccatctccaggattcttttcgataatgtgttcaacatctcctgacacctcatagtggcttataacattatccagtaaatgcaaagtacgatcgatattgtgctgggctttctgaagactttctgtcttattgtatacgggtagaatagtgtcttccagtcgagacaacctctgttcgaaagtatctaaaattgaacctattcctacagtcaactgggcactttttgacagtctttcttgcagcagttttagattctcttgttccttctgtaacttatttgatatctctaatttcttttcttctattaaattcattttcatgttatttttagaaacctaacctaactttatcattgaagttttgtttgacgtctttggtttcc

SEQ ID NO: 1094 - DNA, 2652 bp, Leptinotarsa decemlineata
  Annotation=Exo84
tttattgttgggttatttttatctctagtttttgtttacgtccttaattttccaaaatggattttggaaaagaacccaatcttcagttattgggttctgaggatttcatacctgaaaagtatgtccgagatttatctcataattatgtgggtggatctgaacttcaaactcttcgaagaaaaatacaaatgctttcagaagaaacaagtaacaatctcaagaaaaatgtttatcaaaattatgtgcaattcattgacacagcaaaagagatttcccatttggaaagtgaaatgtaccagttgtcacatttgctctcagaacaaaagttattactaagtgcattgtctactacatccattttagaagatagcacaccagttaatatagaacgtgaaactaaacttagtgaaaaagatttggaggaagaaaacaaacaaaaattagcaacaattttggaaaaagttgaaggatgtaaggaattactggaagttccaggacgaatatttttgtatgaaggagatttactagagattgacccgactgaaaatactgcattaaaaagtgtacatgtatacttgtttactgatggatttatgattacaaacagaaactcaaacagccggggtttgatgaagtacatttatgaaattatttatgatctaagtagtctagctgttgtcaatgtgagggatttgggaaatattaaacatgctttcaaattattgatttttccggataccagagtgtttcagtgttcatcaaattcaaataagaaagaatggctggataagtttgatattgcaaagaagacgagattagcacaagagcaacaaaaaagagaatcagttgtagaaaaatccccgtctcgttcagcttcgatggaatcaccaagtttcaatccattcgatgaggtagaagaggatacaggactggttcatccagaatggtttatagatttaccagaagaacttgatgtatgtgttgcacaaagacactttgaagaagcgttggttttattacagaaagccaaagattatattaatgagtgtcttaccacgaatgaccaattagatcacgtaatgattgatatccaaaggaaggtggaacaaagacaaaataatctcacagaagttttcatgaaggaacttgaagttaatcccgataaatctttgcaaggtggtttacgagcagcaagaagagcagtgagattactaaatcagttaggaaggtcaacgcagtcttgcaacctgttcctcaaactgtgtagcagtatgttaaaaaatcaatgtaagagggttaaaagagagggatctactgcaacctatgtcagacatctttcaagtgtagtctttacaaacatgtgtcacatgtctgaagaatttttgagagcatttcaagattcacccacctgcgcttcagcatatgttatgtgggccagcagcgaattgtctcttttcacaacccattttataaaacaagtattcatgccgcaaacttcgctttcaacaattgctgaatgtgtagtattcataaggacacaatgtgaaaggctttatagttatggagttgatttgtgctatcagctggatggatcgttaatgtcttccttgacgaaagctctgaaggatgccagagataaacttattgattcagtgaaattgagggctattgacgataagtggattccaataaatttgcattcaaagtcagcactggcgaggtgtctccaggagcatgcccaaatgggtcttcatttagagagttacatcacaggtgatacgtggctacaactcacacccagtacattagctttcactaaaatgttcctgctatttttgaatgattgtttgaagttaaaaaccaatgaattgatgtttactatcgatgaaatgctttatagtgtttttgaggcccaagtgagacataatgaaaattcccttcgaattgaaatgaatcaagatcaaaggcagtttctaacaaaaaatgcagagtttttattagtacacctgctggaagttacccaaaaaacatataaggatcatgttggctatgaatgttctactctttccaaacttcaggaagagtattcagcattaacaaagggaatttctccttctacaagaaatatcaaaactgtttattcttcagagtttttataatctacttcaactctttttaaaataaaagtgtaatactttgcttaagatcagtgtgaattattgttccaccaatgaaaaaattgactgattttgttaatttaaagtaaatttaaaaatcaaacgtatccagcagtttcaaaatttatctttgtgattattgatattctcatctgtttttttatgtactatgtgtcactaaaagtgatagtttttagtgtcgccaattttagttgatttatatcactttctagtgatatttccacgtttgaagaaaaatagttgatttattggaaaatagtttcgtgtaggtcgaataattgacaggctcacctagaggttgttcgtcaatcttcatgctcgccacacaaaacattattttttctgctgatgaaatagtgtattattaattgtagaatggtaataataaaggacctacaaatactagaattttcatctattgaattatttaaaatctggtttcaatccatcatac

SEQ ID NO: 1095 - RNA, 277 nt, Artificial sequence
  synthetic construct
gguuucaaauuccgcaacuguuugaagauuggaaagauaaccaaaacuguagcaaagucaugccuugcaauacacuuuuuagcucuggaaauuauauucucuccguccugaacaaugguguccaucgcuucccuaacaaucaauucaaaaacucucgguuggugagcuggcguuaugauaucuuucauaaguaucuguucaaacugcaucaaucuauguagggcuaucacagacauuaaauaauuuuccauuucuuguucauuaucuaguucuuccc

SEQ ID NO: 1096 - RNA, 233 nt, Artificial sequence
  synthetic construct
gccuugcuugugaauggccucccaaaucaaaagucgugaaccucaugcugccgauugacaauucuucugauguaggauguaaagugggaagaugcugugccagccuaucaucuuugagcauaugcaguaaaguuguuuuuccagcauuguccagaccuaggaaaagcagcuugccugauuucuuccauaaucccaaguaaccaaguacaccgguaaaccaaucccagaugaac

SEQ ID NO: 1097 - RNA, 338 nt, Artificial sequence
  synthetic construct
gucgauguacugggccagccaacggaaaccuucuccguaucccugccucuucagaauggagcacaugaagagcucgaggggacguccuggcaaaucggaccuugccaccuuucccuuuccaguuguuuggccauacaaggcauaguaauuucuuaguucgucuuccgaagcugcuugaggcaaaucaauuuuguuaccuaauauaagaaccggacaauucgaaagagucucgucugugaguagcgaauccaauucuuguuuacucucuuugaaucuguuccuaucauuggcaucuacuaaaaagacaauggcgucaacagcagggaaguaguccuucc

SEQ ID NO: 1098 - RNA, 186 nt, Artificial sequence
  synthetic construct
gccuugcuugugaauggccucccaaaucaaaagucgugaaccucaugcugccgauugacaauucuucugauguaggauguaaagugggaagaugcugugccagccuaucaucuuugagcauaugcaguaaaguuguuuuuccagcauuguccagaccuaggaaaagcagcuugccugauuucuucc

SEQ ID NO: 1099 - RNA, 327 nt, Artificial sequence
  synthetic construct
gggccagccaacggaaaccuucuccguaucccugccucuucagaauggagcacaugaagagcucgaggggacguccuggcaaaucggaccuugccaccuuucccuuuccaguuguuuggccauacaaggcauaguaauuucuuaguucgucuuccgaagcugcuugaggcaaaucaauuuuguuaccuaauauaagaaccggacaauucgaaagagucucgucugugaguagcgaauccaauucuuguuuacucucuuugaaucuguuccuaucauuggcaucuacuaaaaagacaauggcgucaacagcagggaaguaguccuucc

SEQ ID NO: 1100 - RNA, 280 nt, Artificial sequence
  synthetic construct
ggucuugccugaacugcgguccaaaauucuccaacaccucgccgaaucguuguaaauuucccauacggacagcuugagucaacugaaaauauggagccaaagaaugccucauacuggacugucugaauaucugccuuuccgguauaucucccagaaggagcucaacuacgacggugaguuuuugcacuguuuggcggaauccaauagcagcguucugaggcgcuuuccucauagcuuguacaagauguuucugagcaacacuauacucuaaccgagccgc

SEQ ID NO: 1101 - RNA, 339 nt, Artificial sequence
  synthetic construct
gggaagcaaauugaagauauccugcagcugguaaaugauuugaugguuaauugguaguuuguucucggagacuuguaucaaguagucucggauuucccgcaguugcaggugcagaccuuucaaaccuaagaguugauugguuauucguugagacaacgugccaacugugguaucuuugauaucccucagaaggugcuccacucccaccuccucugcuucuuccgccccuauuucgcuagguacaugcucaaauguuuuggaagugggcgauccaucaucguggacuuccuccacagcuugauaugccucgguugggaggccuagauccuucgguuuggc

SEQ ID NO: 1102 - RNA, 353 nt, Artificial sequence
  synthetic construct
gggcaucaggguugauuuuaacuuucggcucagucuucuccagaaauguaacugcuucuuuagggucuuuguacugcuccacuaccagggcuacuauuucuaccaaagauaaaggguuuauuuuguuuucgaagguuuguaugaaauugugauaaaguugaauuaaguugucucccuucugcagcucugguuucuuuaugaaggcgaggaguuugagagucaacugaugccauaauuuuuuguugugaaguucuucaaguucugcccauacagaucccaguucuuuagggcuuucuugcuguuuuuuagauaaauacucacugacauuugacuguugcaccgcagcugcagcc

SEQ ID NO: 1103 - RNA, 268 nt, Artificial sequence
  synthetic construct
gaugaugucggacuuuccuaauuugucuucgaugauuugauugcuagugauuggcacccuuuggccguucaccuuggcgaaaccucucuuauaaaucaguucucugacagauuucaaguuaggguauccccaagugauguaagguucgcauauucugagcauguugaugguagcuuuguugagcuugacaaagacaccauuguugauuugaaggagccggaacaauuggagaaccuugcguacuuuaggagcuacuuuguugauaccc

SEQ ID NO: 1104 - RNA, 187 nt, Artificial sequence
  synthetic construct
ggcacccuuuggccguucaccuuggcgaaaccucucuuauaaaucaguucucugacagauuucaaguuaggguauccccaagugauguaagguucgcauauucugagcauguugaugguagcuuuguugagcuugacaaagacaccauuguugauuugaaggagccggaacaauuggagaaccuugc

SEQ ID NO: 1105 - DNA, 963 bp, Artificial sequence
  synthetic construct
taatacgactcactataggggatgatgtcggactttcctaatttgtcttcgatgatttgattgctagtgattggcaccctttggccgttcaccttggcgaaacctctcttataaatcagttctctgacagatttcaagttagggtatccccaagtgatgtaaggttcgcatattctgagcatgttgatggtagctttgttgagcttgacaaagacaccattgttgatttgaaggagccggaacaattggagaaccttgcgtactttaggagctactttgttgataccctttatacgaattacgaatgccaacttggcttcagcgggaacgtaaaagtttcctctggttttagcttgtcggatcaacctaacttcatctctttctttgagccggtattctttaacatactgttcggccaagtactgcgatcgcgttaacgctttatcacgataccttctaccacatatcactaacaacatcaacactcatcatctagactctcgacgacatccactcgtcactactctcacacgaccgattaactcctcatccacgcggccgcgagcggccgaacagtatgttaaagaataccggctcaaagaaagagatgaagttaggttgatccgacaagctaaaaccagaggaaacttttacgttcccgctgaagccaagttggcattcgtaattcgtataaagggtatcaacaaagtagctcctaaagtacgcaaggttctccaattgttccggctccttcaaatcaacaatggtgtctttgtcaagctcaacaaagctaccatcaacatgctcagaatatgcgaaccttacatcacttggggataccctaacttgaaatctgtcagagaactgatttataagagaggtttcgccaaggtgaacggccaaagggtgccaatcactagcaatcaaatcatcgaagacaaattaggaaagtccgacatcatc

SEQ ID NO: 1106 - DNA, 730 bp, Artificial sequence
  synthetic construct
taatacgactcactatagggtacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggaagtactgcgatcgcgttaacgctttatcacgataccttctaccacatatcactaacaacatcaacactcatcactctcgacgacatccactcgatcactactctcacacgaccgattaactcctcatccacgcggccgcctgcaggagcccttctggcagcgccttcaaattagcttgttgtaattccgagtgccttgcccaaattattttaccgccactggcatccatactaactgccggttcttctcttccaactttcactaatatactgccctcgtcataccccagagaaacattattcgaacccttcaagcaacaaatggtccacactctctcgaacccataattcaaacaattctctaatctgtgtgtattcgtatgccaaactctaacggtaccatcttcgctgcctgtgagagccacaggta

SEQ ID NO: 1107 - DNA, 1036 bp, Artificial sequence
  synthetic construct
taatacgactcactataggggtaatttcttagttcgtcttccgaagctgcttgaggcaaatcaattttgttacctaatataagaaccggacaattcgaaagagtctcgtctgtgagtagcgaatccaattcttgtttactctctttgaatctgttcctatcattggcatctactaaaaagacaatggcgtcaacagcagggaagtagtccttccacactcgccttgcttgtgaatggcctcccaaatcaaaagtcgtgaacctcatgctgccgattgacaattcttctgatgtaggatgtaaagtgggaagatgctgtgccagcctatcatctttgagcatatgcagtaaagttgtttttccagcattgtccagacctaggaaaagcagcttgcctgatttcttccataatcccaagtaaccaagtacaccggtaaaccaatcccagatgaacaagtactgcgatcgcgttaacgctttatcacgataccttctaccacatatcactaacaacatcaacactcatcatctagactctcgacgacatccactcgatcactactctcacacgaccgattaactcctcatccacgcggccgcgagcgttcatctgggattggtttaccggtgtacttggttacttgggattatggaagaaatcaggcaagctgcttttcctaggtctggacaatgctggaaaaacaactttactgcatatgctcaaagatgataggctggcacagcatcttcccactttacatcctacatcagaagaattgtcaatcggcagcatgaggttcacgacttttgatttgggaggccattcacaagcaaggcgagtgtggaaggactacttccctgctgttgacgccattgtctttttagtagatgccaatgataggaacagattcaaagagagtaaacaagaattggattcgctactcacagacgagactctttcgaattgtccggttcttatattaggtaacaaaattgatttgcctcaagcagcttcggaagacgaactaagaaattac

SEQ ID NO: 1108 - DNA, 1046 bp, Artificial sequence
  synthetic construct
taatacgactcactataggggtcattgttttttatatagaaggatgagttgaaagtggcttggttaatatcgggaagcaaattgaagatatcctgcagctggtaaatgatttgatggttaattggtagtttgttctcggagacttgtatcaagtagtctcggatttcccgcagttgcaggtgcagacctttcaaacctaagagttgattggttattcgttgagacaacgtgccaactgtggtatctttgatatccctcagaaggtgctccactcccacctcctctgcttcttccgcccctatttcgctaggtacatgctcaaatgttttggaagtgggcgatccatcatcgtggacttcctccacagcttgatatgcctcggttgggaggcctagatccttcggtttggcatcaattattaccaacacagaattgggacagtatctcctaattagttcaagtactgcgatcgcgttaacgctttatcacgataccttctaccacatatcactaacaacatcaacactcatcatctagactctcgacgacatccactcgatcactactctcacacgaccgattaactcctcatccacgcggccgcgagcgaactaattaggagatactgtcccaattctgtgttggtaataattgatgccaaaccgaaggatctaggcctcccaaccgaggcatatcaagctgtggaggaagtccacgatgatggatcgcccacttccaaaacatttgagcatgtacctagcgaaataggggcggaagaagcagaggaggtgggagtggagcaccttctgagggatatcaaagataccacagttggcacgttgtctcaacgaataaccaatcaactcttaggtttgaaaggtctgcacctgcaactgcgggaaatccgagactacttgatacaagtctccgagaacaaactaccaattaaccatcaaatcatttaccagctgcaggatatcttcaatttgcttcccgatattaaccaagccactttcaactcatccttctatataaaaaacaatgac

SEQ ID NO: 1109 - DNA, 1026 bp, Artificial sequence
  synthetic construct
taatacgactcactataggggctagtgtggcaatggacctattagaatcagttatgagattctccaaatccaaattgcaagcagttactgcagcaggatgtgaaatcgcaacctgattgagcgttcggactgctgcaaatctcagtgtcggtttgggggaaccacagaagagttgaagaacacttatagctggagccaattccctgcttgtggtgcgtttcaagttgacaatagcgtgtgctgcttcgtacactaccatttctgatttgtgcctcaggcaggattcaatgaattcaaagtaaggggaatcttcttcctccagaagttttgcggttattcgaatcaacatacaaacagcataaggggatcggagagacatttttgtcaattttgcaattagcttagtaactgctaatcggtcagttttccttatatgatatagtagaccaagtactgcgatcgcgttaacgctttatcacgataccttctaccacatatcactaacaacatcaacactcatcatctagactctcgacgacatccactcgatcactactctcacacgaccgattaactcctcatccacgcggccgcgagcggtctactatatcatataaggaaaactgaccgattagcagttactaagctaattgcaaaattgacaaaaatgtctctccgatccccttatgctgtttgtatgttgattcgaataaccgcaaaacttctggaggaagaagattccccttactttgaattcattgaatcctgcctgaggcacaaatcagaaatggtagtgtacgaagcagcacacgctattgtcaacttgaaacgcaccacaagcagggaattggctccagctataagtgttcttcaactcttctgtggttcccccaaaccgacactgagatttgcagcagtccgaacgctcaatcaggttgcgatttcacatcctgctgcagtaactgcttgcaatttggatttggagaatctcataactgattctaataggtccattgccacactagc

SEQ ID NO: 1110 - DNA, 397 bp, Artificial sequence
  synthetic construct
gatgatgtcggactttcctaatttgtcttcgatgatttgattgctagtgattggcaccctttggccgttcaccttggcgaaacctctcttataaatcagttctctgacagatttcaagttagggtatccccaagtgatgtaaggttcgcatattctgagcatgttgatggtagctttgttgagcttgacaaagacaccattgttgatttgaaggagccggaacaattggagaaccttgcgtactttaggagctactttgttgataccctttatacgaattacgaatgccaacttggcttcagcgggaacgtaaaagtttcctctggttttagcttgtcggatcaacctaacttcatctctttctttgagccggtattctttaacatactgttcggcc

SEQ ID NO: 1111 - DNA, 280 bp, Artificial sequence
  synthetic construct
tacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaagg

SEQ ID NO: 1112 - DNA, 433 bp, Artificial sequence
  synthetic construct
gtaatttcttagttcgtcttccgaagctgcttgaggcaaatcaattttgttacctaatataagaaccggacaattcgaaagagtctcgtctgtgagtagcgaatccaattcttgtttactctctttgaatctgttcctatcattggcatctactaaaaagacaatggcgtcaacagcagggaagtagtccttccacactcgccttgcttgtgaatggcctcccaaatcaaaagtcgtgaacctcatgctgccgattgacaattcttctgatgtaggatgtaaagtgggaagatgctgtgccagcctatcatctttgagcatatgcagtaaagttgtttttccagcattgtccagacctaggaaaagcagcttgcctgatttcttccataatcccaagtaaccaagtacaccggtaaaccaatcccagatgaac

SEQ ID NO: 1113 - DNA, 438 bp, Artificial sequence
  synthetic construct
gtcattgttttttatatagaaggatgagttgaaagtggcttggttaatatcgggaagcaaattgaagatatcctgcagctggtaaatgatttgatggttaattggtagtttgttctcggagacttgtatcaagtagtctcggatttcccgcagttgcaggtgcagacctttcaaacctaagagttgattggttattcgttgagacaacgtgccaactgtggtatctttgatatccctcagaaggtgctccactcccacctcctctgcttcttccgcccctatttcgctaggtacatgctcaaatgttttggaagtgggcgatccatcatcgtggacttcctccacagcttgatatgcctcggttgggaggcctagatccttcggtttggcatcaattattaccaacacagaattgggacagtatctcctaattagttc

SEQ ID NO: 1114 - DNA, 428 bp, Artificial sequence
  synthetic construct
gctagtgtggcaatggacctattagaatcagttatgagattctccaaatccaaattgcaagcagttactgcagcaggatgtgaaatcgcaacctgattgagcgttcggactgctgcaaatctcagtgtcggtttgggggaaccacagaagagttgaagaacacttatagctggagccaattccctgcttgtggtgcgtttcaagttgacaatagcgtgtgctgcttcgtacactaccatttctgatttgtgcctcaggcaggattcaatgaattcaaagtaaggggaatcttcttcctccagaagttttgcggttattcgaatcaacatacaaacagcataaggggatcggagagacatttttgtcaattttgcaattagcttagtaactgctaatcggtcagttttccttatatgatatagtagacc

SEQ ID NO: 1115 - RNA, 377 nt, Artificial sequence
  synthetic construct
gcgaugccaccuacggcaagcugacccugaaguucaucugcaccaccggcaagcugccugugcccuggcccacccuggugaccacccugagcuacggcgugcagugcuucucacgcuaccccgaucacaugaagcagcacgacuucuucaagagcgccaugccugagggcuacauccaggagcgcaccaucuucuucgaggaugacggcaacuacaagucgcgcgccgaggugaaguucgagggcgauacccuggugaaucgcaucgagcugaccggcaccgauuucaaggaggauggcaacauccugggcaauaagauggaguacaacuacaacgcccacaauguguacaucaugaccgacaaggccaagaauggc

What is claimed is:

1. A method for controlling a *Leptinotarsa* species infestation of a plant comprising:
   (a) contacting said *Leptinotarsa* species with a double-stranded RNA (dsRNA) comprising a strand comprising a sequence having at least 98% identity to a sequence selected from the group consisting of: SEQ ID NOs: 989, 988, 1103, 1104, and 1105; or
   (b) providing in the diet of said *Leptinotarsa* species a dsRNA comprising a strand comprising a sequence having at least 98% identity to a sequence selected from the group consisting of: SEQ ID NOs: 989, 988, 1103, 1104, and 1105; or
   (c) causing mortality or stunting in larvae of said *Leptinotarsa* species by providing in the diet of said larvae at least one dsRNA comprising at least one silencing element comprising a strand comprising a sequence having at least 98% identity to a sequence selected from the group consisting of: SEQ ID NOs: 989, 988, 1103, 1104, and 1105; or
   (d) topically applying to said plant a composition comprising at least one dsRNA comprising a strand comprising a sequence having at least 98% identity to a sequence selected from the group consisting of: SEQ ID NOs: 989, 988, 1103, 1104, and 1105, wherein said at least one dsRNA is provided in a manner that permits a *Leptinotarsa* species feeding on said plant to ingest said at least one dsRNA; or
   (e) expressing in said plant at least one dsRNA comprising a strand comprising a sequence having at least 98% identity to a sequence selected from the group consisting of: SEQ ID NOs: 989, 988, 1103, 1104, and 1105, or complementary to a sequence having at least 98% identity to a sequence selected from the group consisting of: SEQ ID NOs: 989, 988, 1103, 1104, and 1105, wherein said at least one dsRNA is ingested by a *Leptinotarsa* species feeding on said plant; or
   (f) providing to said plant at least one dsRNA comprising a strand comprising a sequence having at least 98% identity to a sequence selected from the group consisting of: SEQ ID NOs: 989, 988, 1103, 1104, and 1105, or complementary to a sequence having at least 98% identity to a sequence selected from the group consisting of: SEQ ID NOs: 989, 988, 1103, 1104, and 1105, wherein said at least one dsRNA is ingested by a *Leptinotarsa* species feeding on said plant; or (g) contacting said *Leptinotarsa* species with a dsRNA comprising a strand comprising a sequence having at least 98% identity to a sequence selected from the group consisting of: SEQ ID NOs: 989, 988, 1103, 1104, and 1105, or complementary to a sequence having at least 98% identity to a sequence selected from the group consisting of: SEQ ID NOs: 989, 988, 1103, 1104, and 1105.

2. The method of claim 1, wherein said double-stranded RNA is chemically synthesized or is produced by expression in a microorganism or by expression in a plant cell.

3. The method of claim 1, wherein said double-stranded RNA comprises a strand comprising the sequence selected from the group consisting of: SEQ ID NOs:989, 988, 1103, 1104, and 1105.

4. The method of claim 1, wherein said method comprises topically applying to said plant a composition comprising at least one dsRNA comprising a strand comprising a sequence having at least 98% identity to a sequence selected from the group consisting of: SEQ ID NOs: 989, 988, 1103, 1104, and 1105; and wherein said composition further comprises one or more components selected from the group consisting of a carrier agent, a surfactant, a cationic lipid, an organosilicone, an organosilicone surfactant, a polynucleotide herbicidal molecule, a nonpolynucleotide herbicidal molecule, a non-polynucleotide pesticide, a safener, and an insect growth regulator.

5. The method of claim 1, wherein said method comprises contacting said *Leptinotarsa* species with an effective amount of a solution comprising a double-stranded RNA, wherein at least one strand of the double-stranded RNA comprises at least 98% identity to a sequence selected from the group consisting of: SEQ ID NOs: 989, 988, 1103, 1104, and 1105, wherein said *Leptinotarsa* species is *Leptinotarsa decemlineata*, and wherein RNA interference is induced and *Leptinotarsa decemlineata* mortality occurs.

6. The method of claim 5, wherein said solution further comprises one or more components selected from the group consisting of an organosilicone surfactant or a cationic lipid.

7. The method of claim 1, wherein said method comprises topically applying to said plant a composition comprising at least one dsRNA comprising a strand comprising a sequence having at least 98% identity to a sequence selected from the group consisting of: SEQ ID NOs: 989, 988, 1103, 1104, and 1105; and wherein said *Leptinotarsa* species is *Leptinotarsa decemlineata*.

8. The method of claim 1, wherein said *Leptinotarsa* species is selected from the group consisting of: *Leptinotarsa behrensi*, *Leptinotarsa collinsi*, *Leptinotarsa decemlineata* (Colorado potato beetle), *Leptinotarsa defecta*, *Leptinotarsa haldemani* (Haldeman's green potato beetle), *Leptinotarsa heydeni*, *Leptinotarsa juncta* (false potato beetle), *Leptinotarsa lineolata* (burrobrush leaf beetle), *Leptinotarsa peninsularis*, *Leptinotarsa rubiginosa*, *Leptinotarsa texana*, *Leptinotarsa tlascalana*, *Leptinotarsa tumamoca*, and *Leptinotarsa typographica*.

9. A plant having improved resistance to a *Leptinotarsa* species infestation, provided by the method of claim 1, or a fruit, seed, or propagatable part of said plant, wherein the fruit, seed or propagatable part comprises the dsRNA.

10. The plant of claim 9, wherein said plant is selected from the group consisting of potato, tomato, and eggplant.

11. An insecticidal composition for controlling a *Leptinotarsa* species; comprising:

(a) at least one dsRNA consisting of two strands, wherein a first strand comprises a sequence having at least 98% identity to a sequence selected from the group consisting of: SEQ ID NOs: 989, 988, 1103, 1104; and 1105, wherein said at least one dsRNA causes mortality or stunting of growth in said *Leptinotarsa* species when ingested or contacted by said *Leptinotarsa* species; or (b) at least one dsRNA consisting of at least one silencing element that comprises a strand comprising a sequence having at least 98% identity to a sequence selected from the group consisting of: SEQ ID NOs: 989, 988, 1103, 1104, and 1105, wherein said at least one dsRNA causes mortality or stunting of growth in said *Leptinotarsa* species when ingested or contacted by said *Leptinotarsa* species; or (c) at least one dsRNA consisting of two strands, wherein a first strand comprises a sequence having at least 98% identity to a sequence selected from the group consisting of: SEQ ID NOs: 989, 988, 1103, 1104, and 1105, or complementary to a sequence having at least 98% identity to a sequence selected from the group consisting of: SEQ ID NOs: 989, 988, 1103, 1104, and 1105, wherein said at least one dsRNA causes mortality or stunting of growth in said *Leptinotarsa* species when ingested or contacted by said *Leptinotarsa* species; or (d) a dsRNA molecule that causes mortality or stunting of growth in a *Leptinotarsa* species when ingested or contacted by said *Leptinotarsa* species, wherein said dsRNA molecule consists of two strands, wherein a first strand is at least 98% identical to a sequence selected from the group consisting of: SEQ ID NOs: 989, 988, 1103, 1104, and 1105; or (e) an insecticidal double-stranded RNA molecule that causes mortality or stunting of growth in a *Leptinotarsa* species when ingested or contacted by said *Leptinotarsa* species, wherein at least one strand of said insecticidal double-stranded RNA molecule consists of a sequence comprising at least 98% identity to a sequence selected from the group consisting of: SEQ ID NOs: 989, 988, 1103, 1104, and 1105; or (f) at least one double-stranded RNA consisting of two strands wherein the sequence of a first strand is selected from the group consisting of: SEQ ID NOs:989; 988, 1103, 1104, and 1105, wherein said at least one double-stranded RNA causes mortality or stunting of growth in said *Leptinotarsa* species when ingested or contacted by said *Leptinotarsa* species.

12. The insecticidal composition of claim 11, wherein said insecticidal composition is in the form of at least one selected from the group consisting of a solid, liquid, powder, suspension, emulsion, spray, encapsulation, microbeads, carrier particulates, film, matrix, seed treatment, soil drench, implantable formulation, and in-furrow formulation.

13. The insecticidal composition of claim 11, further comprising at least one component selected from the group consisting of a carrier agent, a surfactant, a cationic lipid, an organosilicone, an organosilicone surfactant, a polynucleotide herbicidal molecule, a non-polynucleotide herbicidal molecule, a nonpolynucleotide pesticide, a safener, and an insect growth regulator.

14. A recombinant DNA construct comprising a heterologous promoter operably linked to:

(a) DNA encoding an RNA comprising at least 98% identity to a nucleotide sequence selected from the group consisting of: SEQ ID NOs:989, 988, 1103, 1104, and 1105, or the complement thereof; or (b) DNA encoding an RNA comprising at least one double-stranded RNA region, at least one strand of which comprises at least 98% identity to the nucleotide sequence selected from the group consisting of: SEQ ID NOs:989, 988, 1103, 1104, and 1105, or the complement thereof; or (c) DNA encoding an RNA comprising the nucleotide sequence selected from the group consisting of: SEQ ID NOs:989, 988, 1103, 1104, and 1105, or the complement thereof.

15. A plant chromosome or a plastid or a recombinant plant virus vector or a recombinant baculovirus vector comprising the recombinant DNA construct of claim 14.

16. A transgenic solanaceous plant cell having in its genome the recombinant DNA construct of claim 14.

17. The transgenic solanaceous plant cell of claim 16, wherein said transgenic solanaceous plant cell further has in its genome DNA encoding at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

18. A transgenic solanaceous plant comprising the transgenic solanaceous plant cell of claim 16, or a fruit, seed, or propagatable part of said transgenic solanaceous plant, wherein the fruit, seed or propagatable part comprises the dsRNA.

* * * * *